US008420102B2

(12) United States Patent
Song et al.

(10) Patent No.: US 8,420,102 B2
(45) Date of Patent: Apr. 16, 2013

(54) COMPOSITIONS THAT INCLUDE HEMAGGLUTININ

(75) Inventors: Langzhou Song, Freehold, NJ (US); Valerian Nakaar, Hamden, CT (US); Albert E. Price, New Haven, CT (US); Lynda G. Tussey, Princeton, NJ (US); James W. Huleatt, Brandford, CT (US); Thomas J. Powell, Madison, CT (US); Robert K. Evans, Souderton, PA (US)

(73) Assignee: VaxInnate Corporation, Cranbury, NJ (US)

( * ) Notice: Subject to any disclaimer, the term of this patent is extended or adjusted under 35 U.S.C. 154(b) by 353 days.

(21) Appl. No.: 11/714,873

(22) Filed: Mar. 6, 2007

(65) Prior Publication Data

US 2007/0253982 A1 Nov. 1, 2007

Related U.S. Application Data

(60) Provisional application No. 60/779,854, filed on Mar. 7, 2006, provisional application No. 60/784,497, filed on Mar. 20, 2006, provisional application No. 60/790, 457, filed on Apr. 7, 2006, provisional application No. 60/814,292, filed on Jun. 16, 2006, provisional application No. 60/830,881, filed on Jul. 14, 2006, provisional application No. 60/838,007, filed on Aug. 16, 2006, provisional application No. 60/856,451, filed on Nov. 3, 2006.

(51) Int. Cl.

| | |
|---|---|
| ***A61K 39/295*** | (2006.01) |
| ***A61K 39/145*** | (2006.01) |
| ***C07K 19/00*** | (2006.01) |
| ***C07K 14/11*** | (2006.01) |

(52) U.S. Cl.
USPC .................. 424/201.1; 424/192.1; 424/210.1

(58) Field of Classification Search ........................ None
See application file for complete search history.

(56) References Cited

U.S. PATENT DOCUMENTS

| | | | |
|---|---|---|---|
| 4,474,757 | A | 10/1984 | Arnon et al. |
| 4,625,015 | A | 11/1986 | Green et al. |

(Continued)

FOREIGN PATENT DOCUMENTS

| | | |
|---|---|---|
| AU | 49273 90 | 8/1990 |
| EP | 0222835 B2 | 9/1994 |

(Continued)

OTHER PUBLICATIONS

Saelens et al. "Protection of mice against a lethal influenza virus challenge after immunization with yeast-derived secreted influenza virus hemagglutinin" Eur. J. Biochem. 260,166-175, 1999.*

(Continued)

*Primary Examiner* — Mary E Mosher
(74) *Attorney, Agent, or Firm* — Hamilton, Brook, Smith & Reynolds, P.C.

(57) ABSTRACT

Methods of making and compositions that stimulate a protective immune response in a subject include a portion of a protein from a naturally occurring viral hemagglutinin, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain. Compositions can further include a Toll-like Receptor agonist and a carrier protein.

34 Claims, 91 Drawing Sheets

Design of Substrate Binding Domain as Influenza Vaccine (PR8)

U.S. PATENT DOCUMENTS

| | | | | |
|---|---|---|---|---|
| 4,659,669 | A * | 4/1987 | Kleid et al. | 435/252.33 |
| 4,666,839 | A | 5/1987 | Souza | |
| 4,752,473 | A | 6/1988 | Nayak et al. | |
| 4,886,748 | A | 12/1989 | Asaka et al. | |
| 5,290,686 | A | 3/1994 | Kendal et al. | |
| 5,601,831 | A | 2/1997 | Green et al. | |
| 5,612,037 | A | 3/1997 | Huebner et al. | |
| 5,700,680 | A | 12/1997 | Newton et al. | |
| 5,762,939 | A | 6/1998 | Smith et al. | |
| 5,777,095 | A | 7/1998 | Barbour et al. | |
| 5,858,368 | A | 1/1999 | Smith et al. | |
| 5,871,747 | A | 2/1999 | Gengoux-Sedlik et al. | |
| 5,891,992 | A | 4/1999 | Stevens | |
| 5,928,644 | A | 7/1999 | Russell-Jones et al. | |
| 5,962,298 | A | 10/1999 | Fiers et al. | |
| 5,965,714 | A | 10/1999 | Ryall | |
| 5,968,776 | A | 10/1999 | Klein et al. | |
| 6,037,135 | A | 3/2000 | Kubo et al. | |
| 6,130,082 | A * | 10/2000 | Majarian et al. | 435/252.3 |
| 6,169,175 | B1 | 1/2001 | Frace et al. | |
| 6,194,546 | B1 | 2/2001 | Newton et al. | |
| 6,245,532 | B1 | 6/2001 | Smith et al. | |
| 6,251,405 | B1 | 6/2001 | Becker et al. | |
| 6,337,070 | B1 | 1/2002 | Okuno et al. | |
| 6,379,675 | B1 | 4/2002 | Becker et al. | |
| 6,541,011 | B2 | 4/2003 | Punnonen et al. | |
| 6,562,798 | B1 | 5/2003 | Schwartz | |
| 6,589,940 | B1 | 7/2003 | Raz et al. | |
| 6,605,457 | B1 | 8/2003 | Fiers et al. | |
| 6,740,325 | B1 | 5/2004 | Arnon et al. | |
| 6,872,395 | B2 | 3/2005 | Kawaoka | |
| 7,129,222 | B2 | 10/2006 | Van Nest et al. | |
| 7,183,111 | B2 | 2/2007 | Van Nest et al. | |
| 7,192,595 | B2 | 3/2007 | Arnon et al. | |
| 7,731,972 | B1 | 6/2010 | Neirynck et al. | |
| 7,732,130 | B2 | 6/2010 | Neirynck et al. | |
| 7,993,652 | B2 | 8/2011 | Neirynck et al. | |
| 2002/0061312 | A1 | 5/2002 | Medzhitov | |
| 2002/0165176 | A1 | 11/2002 | Haynes et al. | |
| 2003/0044429 | A1 | 3/2003 | Aderem et al. | |
| 2003/0099668 | A1 | 5/2003 | Bachmann et al. | |
| 2003/0125278 | A1 | 7/2003 | Tang et al. | |
| 2003/0129197 | A1 | 7/2003 | Fiers et al. | |
| 2003/0175287 | A1 | 9/2003 | Medzhitov et al. | |
| 2003/0175863 | A1 | 9/2003 | Birkett | |
| 2003/0232055 | A1 | 12/2003 | Medzhitov | |
| 2004/0009936 | A1 | 1/2004 | Tang et al. | |
| 2004/0116664 | A1 | 6/2004 | De Filette et al. | |
| 2004/0223976 | A1 | 11/2004 | Bianchi et al. | |
| 2005/0002954 | A1 | 1/2005 | Arnon et al. | |
| 2005/0009008 | A1 | 1/2005 | Robinson et al. | |
| 2005/0147627 | A1 | 7/2005 | Aderem et al. | |
| 2005/0186621 | A1 | 8/2005 | Galarza et al. | |
| 2006/0246092 | A1 | 11/2006 | Neirynck et al. | |
| 2007/0042001 | A1 | 2/2007 | Weeks-Levy et al. | |
| 2007/0042002 | A1 | 2/2007 | Weeks-Levy et al. | |
| 2007/0122421 | A1 | 5/2007 | Medzhitov | |
| 2007/0160623 | A1 | 7/2007 | Medzhitov | |
| 2007/0224205 | A1 | 9/2007 | Powell et al. | |
| 2008/0008725 | A1 | 1/2008 | Weeks-Levy | |
| 2008/0063657 | A1 | 3/2008 | Powell et al. | |
| 2008/0124361 | A1 | 5/2008 | Mizel et al. | |
| 2008/0193487 | A1 | 8/2008 | Schild et al. | |
| 2008/0220011 | A1 | 9/2008 | Mizel | |
| 2008/0226667 | A1 | 9/2008 | Medzhitov | |
| 2009/0081725 | A1 | 3/2009 | Powell et al. | |
| 2009/0162400 | A1 | 6/2009 | Powell et al. | |
| 2010/0303847 | A1 | 12/2010 | Nakaar et al. | |
| 2011/0008383 | A1 | 1/2011 | Powell et al. | |
| 2011/0117128 | A1 | 5/2011 | Powell et al. | |
| 2011/0135680 | A1 | 6/2011 | Song et al. | |

FOREIGN PATENT DOCUMENTS

| | | | |
|---|---|---|---|
| EP | 0621339 | B1 | 10/2001 |
| EP | 0932625 | B1 | 8/2003 |
| EP | 1002093 | B1 | 4/2005 |
| EP | 0833933 | B1 | 9/2005 |
| EP | 0941315 | B1 | 3/2006 |
| WO | 8706590 | | 11/1987 |
| WO | 8801873 | | 3/1988 |
| WO | WO 89/10967 | | 11/1989 |
| WO | WO 93/03173 | | 2/1993 |
| WO | WO 93/20846 | | 10/1993 |
| WO | WO 94/24290 | | 10/1994 |
| WO | WO 96/37624 | | 11/1996 |
| WO | 9823288 | | 6/1998 |
| WO | WO 98/23735 | | 6/1998 |
| WO | 9848026 | | 10/1998 |
| WO | 9850547 | | 11/1998 |
| WO | WO 99/07839 | | 2/1999 |
| WO | WO 99/28478 | | 6/1999 |
| WO | 9939735 | | 8/1999 |
| WO | WO 00/32228 | | 8/2000 |
| WO | 0060069 | | 10/2000 |
| WO | WO 02/00885 | A2 | 1/2002 |
| WO | WO 02/09748 | | 2/2002 |
| WO | WO 02/09748 | A1 | 2/2002 |
| WO | WO 02/085933 | | 10/2002 |
| WO | WO 03/102165 | A2 | 12/2003 |
| WO | WO 2004/014956 | A1 | 2/2004 |
| WO | WO 2004/076621 | A2 | 9/2004 |
| WO | WO 2004/080403 | A2 | 9/2004 |
| WO | WO 2005/042564 | A2 | 5/2005 |
| WO | WO 2005/055957 | A2 | 6/2005 |
| WO | WO 2005/077408 | | 8/2005 |
| WO | WO 2006/040076 | A2 | 4/2006 |
| WO | WO 2006/069262 | A2 | 6/2006 |
| WO | WO2006/078657 | | 7/2006 |
| WO | WO 2006/078657 | A2 | 7/2006 |
| WO | 2006083706 | | 8/2006 |
| WO | 2006083792 | | 8/2006 |
| WO | WO 2006/081007 | A2 | 8/2006 |
| WO | WO 2007/022425 | A2 | 2/2007 |
| WO | WO 2007/066334 | A1 | 6/2007 |
| WO | WO 2007/085969 | A2 | 8/2007 |
| WO | WO 2007/125535 | A1 | 11/2007 |

OTHER PUBLICATIONS

Murthy KG et al. "Identification of Conserved Domains in *Salmonella muenchen* Flagellin That Are Essential for Its Ability to Activate TLR5 and to Induce an Inflammatory Response in Vitro" The Journal of Biological Chemistry; vol. 279, No. 7, Issue of Feb. 13, pp. 5667-5675, 2004.*

Eaves-Pylers et al. "*Salmonella* flagellin-dependent proinflammatory responses are localized to the conserved amino and carboxyl regions of the protein." J Immunol. Dec. 15, 2001;167(12):7009-16.*

Daniels et al (Molecular Cell 11:79-90, 2003).*

Cuadros, C., et al. "Flagellin fusion proteins as adjuvants or vaccines induce specific immune responses," *Infection and Immunity*, 72(5):2810-2816 (May 2004).

Obert, M., et al., "Protection of Mice Against SV40 Tumours by $Pam_3Cys$, MTP-PE and $Pam_3Cys$ Conjugated with the SV40 T antigen-derived peptide, K(698)-T(708)," *Vaccine*, 16(2-3):161-169 (Jan. 1998).

Singh, Bhanu, P., et al., "Toll-Like Receptors and their role in Innate Immunity," *Current Science*, 85(8):1156-1164 (Oct. 2003).

International Search Report and Written Opinion of the International Search Authority issued on Jun. 12, 2007, in international application PCT/US2007/005611.

Wu, J.Y., et al., "Expression of Immunogenic Epitopes of Hepatitis B Surface Antigen with Hybrid Flagellin Proteins by a Vaccine Strain of *Salmonella*," *Proc. Nat. Acad. Sci. USA*, 86:4726-4730 (1989).

Newton, S.M.C., et al., "Immune Response to Cholera Toxin Epitope Inserted in *Salmonella* Flagellin," *Science*, 244(4900):70-72 (1989).

Westerlund-Wilkstrom, B., et al., "Peptide Display on Bacterial Flagella: Principles and Applications," *Int. J. Med. Microbiol.*, 290(3):223-230 (2000).

Smith, K.D., et al., "Toll-like Receptor 5 Recognizes a Conserved Site on Flagellin Required for Protofilament Formation and Bacterial Motility," *Nat. Immunology*, 4(12):1247-1253 (2003).

Allen, et al., "Influenza Virus RNA Segment 7 Has the Coding Capacity for Two Polypeptides," *Virology*, 107:548-551 (1980).

Applequist, S.E., et al. "Activation of Innate Immunity, Inflammation, and Potentiation of DNA Vaccination through Mammalian Expression of the TLR5 Agonist Flagellin" *J. Immunol.* 175:3882-3891 (2005).
Arnon, R. et al. "Peptide-based Synthetic Recombinant Vaccines with Anti-viral Efficacy" *Biologicals*, 29:237-242 (2001).
Bamps, Bart, Insertion of Nucleoprotein T-Cell Epitope of the Influrnza A Virus in the M2 Hepatitis B Core Fusion Protein (1996-1997) (unpublished dissertation, University of Ghent).
Ben-Yedidia, T., et al. "Intranasal administration of peptide vaccine protects human/mouse radiation chimera from influenza infection" *Internation Immunol.*11(7):1043-1051 (1999).
Bianchi, E., et al., "Universal Influenza B Vaccine Based on the Maturational Cleavage Site of the Hemagglutinin Precursor," *J. of Virology*, 79(12):7380-7388 (2005).
Black, R.A., et al., "Antibody Response to the M2 Protein of Influenza A Virus Expressed in Insect Cells," *J. of General Virology* 74:143-146 (1993).
Borisova, G.P., et al., "Recombinant Core Particles of Hepatitis B Virus Exposing Foreign Antigenic Determinants on Their Surface," *FEBS Letters*, 259:121-124 (1989).
Bright, R.A., et al., "Impact of glycosylation and immunogenicity of DNA-based influenza H5 HA vaccine," *Virology*, 308:270-278 (2003).
Brown, A.L., et al., "Foreign Epitopes in Immunodominant Regions of Hepatitis B Core Particles are Highly Immunogenic and Conformationally Restricted," *Vaccine*, 9:595-601 (1991).
Charbit, A., et al., "Probing and Topology of a Bacterial membrane Protein by Genetic Insertion of a Foreign Epitope; Expression at the Cell Surface," *EMBO J.*, 5:3029-3037 (1986).
Charbit, A., et al., "Presentation of Two Epitopes of the preS2 Region of Hepatitis B Virus on Live Recombinant Bacteria," *J. Immunol.*, 139:1658-1664 (1987).
Clarke, B.E., et al., "Improved Immunogenicity of a Peptide Epitope After Fusion to Hepatitis B Core Protein," *Nature*, 330:381-384 (1987).
Clarke, B.E., et al., "Presentation and Immunogenicity of Viral Epitopes on the Surface of a Hybrid Hepatitis B Virus Core Particles Produced in Bacteria," *J. General Virology*, 71:1109-1117 (1990).
Cox, et al., "Identification of Sequence Changes in the Cold-Adapted, Live Attenuated Influenza Vaccine Strain, A/Ann Arbor/6/60 (H2N2)," *Virology*, 167:554-567 (1988).
das Gracas Luna, M., et al., "*Salmonella* Flagellin Fused with a Linear Epitope of Colonization Factor Antigen I (CFA/I) Can Prime Antibody Responses Against Homologous and Heterologous Fimbriae of Entertoxigenic *Escherichia coli," Research in Microbiology*, 151: 575-582 (2000).
Donnelly, M. A. et al. "Two Nonadjacent Regions in Enteroaggregative *Escherichia coli* Flagellin Are Required for Activation of Toll-like Receptor 5" *J. Biol. Chem.* 277(43):40456-40461 (2002).
EMBL U02084.
Fan, J. et al. "Preclinical study of influenza virus A M2 peptide conjugate vaccines in mice, ferrets, and rhesus monkeys" *Vaccine*, 22:2993-3003 (2004).
Francis, M.J., et al., "Immunological Properties of Hepatitis B Core Antigen Fusion Proteins," *Proc. Natl. Acad. Sci.*, 87:2545-2549 (1990).
Francis, M.J., et al., "Peptide Vaccines Based on Enhanced Immunogenicity of Peptide Epitopes Presented with T-Cell Determinants or Hepatitis B Core Protein," In: *Antibodies, Antigens, and Molecular Mimicry, Methods in Enzymology* vol. 178, JJ. Langone, editor, pp. 659-676, Academic Press, Inc., New York (1989).
Gamblin, S.J. et al. "The structure and receptor binding properties of the 1918 influenza hemagglutinin" *Science*, 303:1838-1842 (2004).
Heinen, P.P. et al. "Vaccination of pigs with a DNA construct expressing an influenza virus M2-nucleoprotein fusion protein exacerbates disease after challenge with influenza A virus" *J. General Virol.* 83:1851-1859 (2002).
Hongo, S., et al., "Characterization of a Second Protein (CM2) Encoded by RNA Segment 6 of Influenza C Virus," *J. of Virol.*, 71(4):143-146 (1993).
Horvath, A., et al., "A Hemagglutinin-based Multipeptide Construct Elicits Enhanced Protective Immune Response in Mice Against Influenza A Virus Infection," *Immunol. Lett.*, 60:127-136 (1998).
Huleatt, J.W. et al. "Vaccination with recombinant fusion proteins incorporating Toll-like receptor ligands induces rapid cellular and humoral immunity" *Vaccine*, 25:763-775 (2006).
Jeon, S.H. et al., "Immunization with Influenza Virus Hemagglutinin Globular Region Containing the Receptor-Binding Pocket" *Viral Immunol*, 15(1):165-176 (2002).
Jeon, S.H. et al., "Intranasal Immunization with Synthetic Recombinant Vaccine Containing Multiple Epitopes of Influenza Virus," *Vaccine*, 20:2772-2780 (2002).
Katz, J.M., et al., "Immune Mechanisms of Protection Induced by Vaccination of BALB/c Mice with Influenza A Virus M2 Protein," *Options for the Control of Influenza III* (Brown, L.E. et al. eds.), Intl. Congress Series 1123:837-843 (1996).
Kovacsovics-Bankowski, M., et al., "Efficient Major Histocompatibility Complex Class I Presentation of Exogeneous Antigen Upon Phagocytosis by Macrophages," *PNAS*, 90:4942-4946 (1993).
Lamb, R.A., et al., "Influenza Virus M2 Protein is an Integral Membrane Protein Expressed on the Infected-cell Surface," *Cell*, 40:627-633 (1985).
Levi, R. and Arnon, R., "Synthetic Recombinant Influenza Vaccine Induces Efficient Long-Term Immunity and Cross-Strain Protection," A148(1):85-92 (1996).
Liu, M. et al. "Deletion of N-glycosylation sites of hepatitis C virus envelope protein E1 enhances specific cellular and humoral immune responses," *Vaccine*, 25:6572-6580 (2007).
Martinet, W., et al., "Protection of Mice Against a Lethal Influenza Challenge by Immunization with Yeast-derived Recombinant Influenza Neuraminidase," *Eur. J. Biochem.*, 247:332-338 (1997).
McEwen, J., et al., "Synthetic Recombinant Vaccine Expressing Influenza Heamagglutinin Epitope in *Salmonella* Flagellin Leads to Partial Protection in Mice," *Vaccine*, 10(6): 405-411 (1992).
McSorley, S.J., et al. "Bacterial Flagellin is an Effective Adjuvant for CD4+ T Cells In Vivo" *J. Immunol.* 169:3914-3919 (2002).
Milich, D.R., et al., "The Hepatitis Nucleocapsid as a Vaccine Carrier Moiety," *Ann N Y Acad Sci.*, 754:187-201 (1995).
Murthy, K.G.K. et al. "Identification of Conserved Domains in *Salmonella muenchen* Flagellin That Are Essential for Its Ability to Activate TLR5 and to Induce an Inflammatory Response in Vitro" *J. Biol. Chem.*, 279:5667-5675 (2004).
Nagy, Z., et al., "The Intersubunit Region of the Influenza Virus Haemagglutinin is Recognized by Antibodies During Infection," *Scand. J. Immunol.*, 40:281-291 (1994).
Nayak, D.P. et al. "Biological and immunological properties of haemagglutinin and neuraminidase expressed from cloned cDNAs in prokaryotic and eukaryotic cells" *Vaccine*, 3:165-171 (1985).
Neirynck, Sabine, An Expression Plasmid Leading to the Presentation of Influenza M2 Protein Epitopes on the *E. coli* Cell Surface (1987-1988) (unpublished dissertation, State University of Ghent).
Petrenko, V.A., et al., "Cloning and Expression in *Escherichia coli* of the Hemagglutinin Gen of Influenza Virus Subtype H1," *Molecular Biology*, 23(No. 3, Part 2):704-712 (1989).
Petrenko, V.A., et al., "Construction of a Gene of Hybrid Influenza Virus Hemagglutinin," *Molecular Biology*, 24(No. 2, Part 1):331-339 (1990).
Pouwels, et al., "The Potential of Lactobacillus as a Carrier for Oral Immunication: Development and Preliminary Characterization of Vector Systems for Targeted Delivery of Antigens," *J. of Biotechnol.*, 44:183-192 (1996).
Pumpens, P., et al., "Hepatitis B Virus Core Particles as Epitope Carriers," *Intervirology*, 38:63-74 (1995).
Saelens, X. et al. "Protection of mice against a lethal influenza virus challenge after immunization with yeast-derived secreted influenza virus hemagglutinin" *J. Biochem.*, 260:166-175 (1999).
Slepushkin, V.A., et al. "Protection of Mice Against Influenza A Virus Challenge by Vaccination with Baculovirus-expressed M2 Protein," *Vaccine*, 13(15):1399-1402 (1995).
Stocker, B.A.D., et al., "Immune Responses to Epitopes Inserted in *Salmonella* Flagellin," *Intern. Rev. Immunol*, 11:167-178 (1994).
Sugrue, R.J., et al., "Palmitoylation of the Influenza A Virus M2 Protein," *Virol.*, 179:51-56 (1990).

Treanor, J.J., et al., "Dose-related safety and immunogenicity of a trivalent baculovirus-expressed influenza-virus hemagglutinin vaccine in elderly adults" *J. Infectious Disease*, 193:1223-1228 (2006).
Treanor, J.J., et al., "Passively Transferred Monoclonal Antibody to the M2 Protein Inhibits Influenza A Virus Replication in Mice," *J. of Virol.*, 64(3): 1375-1377 (1990).
Tung, C.-S., et al. "Homology model of the structure of influenza B virus HA1" *J. General Virol.*, 85:3249-3259 (2004).
Ulrich, R., "Core Particles of Hepatitis B Virus as Carrier for Foreign Epitopes," *Advances in Virus Research*, 50:141-182 (1998).
Vanlandschoot, P., et al., "Molecular and Immunological Characterization of Soluble Aggregated A/Victoria/3/75 (H3N2) Influenza Haemagglutinin Expressed in Insect Cells," *Arch. Virol.*, 141:1715-1726 (1996).
von Brun, A., et al., "Principal Neutralizing Domain of HIV-1 is Highly Immunogenic when Expressed on the Surface of Hepatitis B Core Particles," *Vaccine*, 11:817-824 (1993).
Wells, J.M., et al., "*Lactococcus lactis*: High-level Expression of Tetanus Toxin Fragment C and Protection Against Lethal Challenge," *Molecular Microbiology* 8(6):1155-1162 (1993).
Wyant, T.L., et al., "Potent Immunoregulatory Effects of *Salmonella typhi* Flagella on Antigenic Stimulation of Human Peripheral Blood Mononuclear Cells," *Infection and Immunity*, 67(3):1338-1346 (1999).
Wyant, T.L., et al., "*Salmonella typhi* Flagella are Potent Inducers of Proinflammatory Cytokine Secretion by Human Monocytes," *Infection and Immunity*, 67(7):3619-3624 (1999).
Zebedee, S.L. and Lamb, R.A., "Influenza A Virus M2 Protein: Monoclonal Antibody Restriction of Virus Growth and Detection of M2 in Virions," *J. Virol.*, 62:2762-2772 (1988).
Zebedee, S.L., et al., "Characterization of the Influenza Virus M2 Intergral Membrane Protein and Expression at the Infected-cell Surface from Cloned cDNA," *J. Virol.*, 56:502-511 (1985).
Zeng, W., et al. "Totally synthetic lipid-containing polyoxime peptide constructs are potent immunogens" *Vaccine*, 18:1031-1039 (2000).
Ben-Yedidia, T. and Arnon, R., "Towards an Epitope-Based Human Vaccine for Influenza," *Human Vaccines* 1(3):95-101 (2005).
De Filette, M., et al., "Universal Influenza A Vaccine: Optimization of M2-Based Constructs," *Virology* 337:149-161 (2005).
Geisse, S., et al., "Eukaryotic Expression Systems: A Comparison," *Protein Expression and Purification* 8:271-282 (1996).
Huleatt, J.W., et al., "Vaccination with Recombinant Fusion Proteins Incorporating Toll-Like Receptor Ligands Induces Rapid Cellular and Humoral Immunity," *Vaccine* 25:763-775 (2007).
Jegerlehner, A., et al., "A Molecular Assembly System that Renders Antigens of Choice Highly Repetitive for Induction of Protective B Cell Responses," *Vaccine* 20:3104-3112 (2002).
Treanor, J.J., et al., "Safety and Immunogenicity of a Recombinant Hemagglutinin Vaccine for H5 Influenza in Humans," *Vaccine* 19:1732-1737 (2001).
Weimer, E.T., et al., "Immunization of Young African Green Monkeys with OprF Epitope 8-Oprl-Type A- and B-flagellin Fusion Proteins Promotes the Production of Protective Antibodies Against Nonmucoid *Pseudomonas aeruginosa," Vaccine*, doi:10.1016/j.vaccine.2009.08.080 (pp. 1-8), (2009).
Weimer, E.T., et al., "A Fusion Protein Vaccine Containing OprF Epitope 8, OprI, and Type A and B Flagellins Promotes Enhanced Clearance of Nonmucoid *Pseudomonas aeruginosa," Infection and Immunity*, 77(6):2356-2366 (2009).
Mizel, S.B., et al., "Flagellin-F1-V Fusion Protein is an Effective Plague Vaccine in Mice and Two Species of Nonhuman Primates," *Clinical and Vaccine Immunology*, 16(1):21-28 (2009).
Akira, S., et al., "Recognition of Pathogen-associated Molecular Patterns by TLR Family," Immuno. Letters, 85:85-95 (2003).
Barton, G. M., and R. Medzhitov, "Control of Adaptive Immune Responses by Toll-Like Receptors," Curr Opin Immunol 14:380-383 (Jun. 2002).
Beatson, S., et al., "Variation in Bacterial Flagellins: From Sequence to Structure," Trends in Microbiology, 14:151-156 (Apr. 2006).
Becker, R.S., et al., "Co-Administration of Soluble and Particulate Forms of Conjugate, OSPA, and HA Antigens Synergistically Enhance Immune Responses," Vaccines, 93:347-351 (1993).
Bendelac, A. and R. Medzhitov, "Adjuvants of Immunity: Harnessing Innate Immunity to Promote Adaptive immunity," J Exp Med 195(5): F19-23 (2002).
Ben-Yedidia, T., et al., "Intranasal Administration of Synthetic Recombinant Peptide-Based Vaccine Protects Mice From Infection by *Schistosoma mansoni*," Infection and Immunity, 67(9):4360-4366 (1999).
Blander, J. M. and R. Medzhitov, "Toll-Dependent Selection of Microbial Antigens for Presentation by Dendritic Cells." Nature 440(7085): 808-812 (Feb. 2006).
Cornelis, P., et al., "Development of New Cloning Vectors for the Production of Immunogenic Outer Membrane Fusion Proteins in *Escherichia coli*," Bio/Technology, 14:203-208 (1996).
Database UniProt [Online], "SubName: Full=Phase 2 flagellin;" XP002539993, retrieved from EBI accession No. UniProt:Q6V357, Database accession No. Q6V357, abstract (Jul. 2004).
Eaves-Pyles, T., et al., "Flagellin, a Novel Mediator of *Salmonella*-Induced Epithelial Activation and Systematic Inflammation: IκBα Degradation, Induction of Nitric Oxide Synthase, Induction of Proinflammatory Mediators, and Cardiovascular Dysfunction," J. Immunol, 166:1248-1260 (2001).
Eaves-Pyles, T.D., et al., "*Salmonella* Flagellin-Depedent Proinflammatory Responses are Localized to the Conserved Amino and Caroxyl Regions of the Protein," Journal of Immunology, American Association of Immunologists, US, 167 (12):7009-7016, XP002341395, ISSN: 0022-1767, abstract (Dec. 2001).
Fearon, D.T., and Locksley, R.M., "The Instructive Role of Innate Immunity in the Acquired Immune Response," Science, 272:50-54 (Apr. 1996).
Fiers, W., et al., "A "Universal" Human Influenza A Vaccine," Virus Research 103:173-176 (2004).
Fingerut, E., et al., "B Subunit of *E. coli* Enterotoxin as Adjuvant and Carrier in Oral and Skin Vaccination," Vet Immunol Immunopathol 112:253-263 (2006).
Frace, A.M., et al., "Modified M2 Proteins Produce Heterotypic Immunity Against Influenza A Virus," Vaccine 17:2237-2244 (1999).
Gewirtz, A.T., et al., "*Salmonella typhimurium* Translocates Flagellin Across Intestinal Epithelia, Inducing a Proinflammatory Response," J. Clin. Invest., 107(1):99-109 (2001).
Granoff, D.M., et al., "Effect of immunity to the carrier protein on antibody responses to *Haemophilus influenzae* type b conjugate vaccines," Vaccine 11:Suppl 1:S46-51 (1993).
Hayashi, F., et al., "The Innate Immune Response to Bacterial Flagellin is Mediated by Toll-Like Receptor 5," Nature, 410:1099-1103 (Mar. 2001).
Honko, A.N., et al., "Mucosal Administration of Flagellin Induces Innate Immunity in the Mouse Lung," Infection and Immunity, 72(11):6676-6679 (2004).
Ibrahim, G.F., et al., "Method for the isolation of highly purified *Salmonella* flagellins.," J. Clin. Microbial., 22:1040-1044, (1985).
International Preliminary Report on Patentability for PCT/US2005/046662, date of mailing Jun. 26, 2007.
International Preliminary Report on Patentability for PCT/US2007/005611, date of mailing Sep. 9, 2008.
Jegerlehner, A., et al., "Influenza A Vaccine Based on the Extracellular Domain of M2: Weak Protection Mediated via Antibody-Dependent NK Cell Activity," J. Immunol. 172: 5598-5605 (May 2004).
Kopp, E.B. and Medzhitov, R., "The Toll-Receptor Family and Control of Innate Immunity," Current Opinion in Immunology, 11:13-18 (1999).
Liu, J., et al., "Highly Pathogenic H5N1 Influenza Virus Infection in Migratory Birds," Science, 309:1206 (Aug. 2005).
Liu, W. et al., "Monoclonal Antibodies Recognizing EVETPRIN Epitope of Influenza A Virus M2 Protein Could Protect Mice from Lethal Influenza A Virus Challenge," Immunol Lett 93:131-136 (2004).
McQuiston, J.R., et al., "Sequencing and Comparative Analysis of Flagellin Genes flicC, fljB, and flpA from *Salmonella*," J. of Clinical Micro., 42(5):1923-1932 (2004).
Means, T. K., et al., "The 5 Stimulus Bacterial Flagellin Induces Maturation and Chemokine Production in Human Dendritic Cells." J Immunol 170(10): 5165-75 (May 2003).

Medzhitov, R., "Toll-Like Receptors and Innate Immunity," Nature Reviews Immunology, 1:135-145 (Nov. 2001).
Medzhitov, R., and Janeway, Jr., C., "An Ancient System of Host Defense," Current Opinion in Immunology, 10:12-15 (1998).
Medzhitov, R., and Janeway, Jr., C., "Innate Immune Recognition and Control of Adaptive Immune Responses," Seminars in Immunology, 10:351-353 (1998).
Medzhitov, R., and Janeway, Jr., C., "Innate Immune Recognition: Mechanism and Pathways," Immunological Reviews, 173:89-97 (2000).
Medzhitov, R., and Janeway, Jr., C., "Innate Immunity," The New England Journal of Medicine, 343:338-344 (2000).
Medzhitov, R., and Janeway, Jr., C., "Innate Immunity: Impact on the Adaptive Immune Response," Current Opinion in Immunology, 9(1):4-9 (1997).
Medzhitov, R., and Janeway, Jr., C., "Innate Immunity: The Virtues of a Nonclonal System of Recognition," Cell, 91:295-298 (Nov. 1997).
Medzhitov, R., and Janeway, Jr., C., "Self-Defense: The Fruit Fly Style," Proc. Natl. Acad. Sci. USA, 95:429-430 (1998).
Medzhitov, R., and Janeway, Jr., C., "The Toll Receptor Family and Microbial Recognition," Trends in Microbiology, 8 (10):452-456 (Oct. 2000).
Medzhitov, R., et al., "A Human Homologue of the *Drosophila* Toll Protein Signals Activation of Adaptive Immunity," Nature, 388:394-397 (Jul. 1997).
Medzhitov, R., et al., "How Does the Immune System Distinguish Self from Nonself?" Seminars in Immunology, 12:185-188 (2000).
Medzhitov, R., et al., "MyD88 is an Adaptor Protein in the hToll/IL-1 Receptor Family Signaling Pathways," Molecular Cell, 2:253-258 (1998).
Mowat, A. McI., et al., "Oral Vaccination with Immune Stimulating Complexes," Immunology Letters, 65:133-140 (1999).
Murthy K.G.K. et al., "Identification of Protein Motifs and the Role of Particular Amino Acids in Biological Activity of Flagellin as an Inducer of Proinflammatory Responses in Human Cells," FASEB Journal, Fed. of American Soc. For Experimental Biology, Bethesda, MC, US, vol. 17, No. 4-5, Mar. 1, 2003, p. Abstract 601.2, XP009120942, ISSN: 0892-6638, abstract.
Neirynck, S., "A Universal Influenza A vaccine based on the Extracellular Domain of the M2 Protein," Nature Medicine 5:1157-1163 (1999).
Notification of Transmittal of the International Search Report and the Written Opinion of the International Searching Authority for PCT/US2005/046662.
O'Hagan, D.T., et al., "Recent Developments in Adjuvants for Vaccines Against Infectious Diseases," Biomol. Eng., 18:69-85 (2001).
Pasare, C. and R. Medzhitov, "Toll-Like Receptors and Acquired Immunity." Semin Immunol 16(1): 23-6 (2004).
Powers, D.C., et al., "Influenza A Virus Vaccines Containing Purified Recombinant H3 Hemagglutinin are Well Tolerated and Induce Protective Immune Responses in Healthy Adults," Journal of Infectious Diseases, 171:1595-1599 (Jan. 1995).
Rock, F.L., et al., A Family of Human Receptors Structurally Related to *Drosophila* Toll, PNAS 95:588-593 (1998).
Sadoff, J. C., et al., "Oral *Salmonella typhimurium* vaccine expressing circumsporozoite protein protects against malaria," Science 240(4850): 336-8 (1988).
Salman, H.H. et al., "*Salmonella*-like Bioadhesive Nanoparticles," Journal of Controlled Release, Elsevier, Amsterdam, NL, (106)1-2,:1-13, XP005023644, ISSN: 0168-3659, abstract (Aug. 2005).
Gugolya et al., "Interaction of the Disorder Terminal Regions of Flagellin Upon Flagellar Filament Formation," *FEBS Letters*, 2003, vol. 535, pp. 66-70.
Yoshioka et al., "Flagellar Filament Structure and Cell Motility of *Salmonella typhimurium* Mutants Lacking Part of the Outer Domain of Flagellin," *Journal of Bacteriology*, 1995, vol. 177, pp. 1090-1093.
Andersen-Nissen et al., "Evasion of Toll-like Receptor 5 by Flagellated Bateria," *PNAS*, Jun. 13, 2005, vol. 102, pp. 9247-9252.
Schnare, M., et al., "Toll-Like Receptors Control Activation of Adaptive Immune Responses," Nature Immunology, 2 (10):947-950 (Sep. 2001).
Smith, R.E., et al., "Immune-Stimulating Complexes Induce an IL-12-Dependent Cascade of Innate Immune Responses," The Journal of Immunology, 162:5536-5546 (1999).
U.S. Office Action dated Jul. 26, 2010 for U.S. Appl. No. 11/820,148.
U.S. Office Action dated Mar. 3, 2010 for U.S. Appl. No. 11/820,148.
van Duin, D., et al., "Triggering TLR Signaling in Vaccination," Trends Immunol 27(1): 49-55 (2006).
Westerlund-Wikstrom, B., et al., "Functional Expression of Adhesive Peptides as Fusions to *Escherichia coli* Flagellin," Protein Engineering, 10(11):1319-1326 (1997).
Yinghua, L., "Progress in the Study of the Flagellins from *Salmonella*," Foreign Medical Science (Volume Microbiology) 5:24-26 (2002).
Pasare, C., and R. Medzhitov, "Toll-dependent control mechanisms of CD4 T cell activation", *Immunity*, 21:733-741 (2004).

* cited by examiner

Design of Substrate Binding Domain as Influenza Vaccine (PR8)

| 4-P Fit: y = (A - D)/( 1 + (x/C)^B ) + D: | A | B | C | D | R^2 |
|---|---|---|---|---|---|
| ○ Plot#1 (REF STF24xM2e@Experiment#1: Dilution vs ... | 0.802 | 0.747 | 2256.726 | 391.104 | 0.98 |
| □ Plot#2 (Mal 1-2 Pellet@Experiment#1: Dilution vs Mea... | 8.074 | 2.026 | 6520.987 | 221.39 | 1 |
| △ Plot#3 (SH 1-2 Pellet@Experiment#1: Dilution vs Mea... | 6.638 | 1.686 | 8508.737 | 251.886 | 0.999 |
| ◇ Plot#4 (Mal 1-1 Pellet@Experiment#1: Dilution vs Mea... | 8.141 | 2.621 | 9795.127 | 160.022 | 1 |

Curve Fit Option - Fixed Weight Value: 1

| 4-P Fit: y = (A - D)/( 1 + (x/C)^B ) + D: | A | B | C | D | R^2 |
|---|---|---|---|---|---|
| ○ Plot#1 (REF STF24xM2e@Experiment#1: Dilution vs ... | -11.075 | 0.501 | 10458.24 | 530.647 | 0.982 |
| □ Plot#2 (Mal 1-2 Sup@Experiment#1: Dilution vs Mean... | 9.743 | 1.712 | 8003.096 | 110.268 | 0.996 |
| △ Plot#3 (SH 1-2 Sup@Experiment#1: Dilution vs Mean... | 10.11 | 1.703 | 13620.02 | 128.77 | 0.997 |
| ◇ Plot#4 (Mal 1-1 Sup@Experiment#1: Dilution vs Mean... | 10.599 | 1.047 | 5.86e5 | 1302.212 | 0.983 |

Curve Fit Option - Fixed Weight Value: 1

MAQVINTNSLSLLTQNNLNKSQSALGTAIERLSSGLRINSAKDDAAGQAIANRFTANIKG

LTQASRNANDGISIAQTTEGALNEINNNLQRVRELAVQSANSTNSQSDLDSIQAEITQRL

NEIDRVSGQTQFNGVKVLAQDNTLTIQVGANDGETIDIDLKQINSQTLGLDSLNVQKAYD

VKDTAVTTKAYANNGTTLDVSGLDDAAIKAATGGTNGTASVTGGAVKFDADNNKYFVTIG

GFTGADAAKNGDYEVNVATDGTVTLAAGATKTTMPAGATTKTEVQELKDTPAVVSADAKN

ALIAGGVDATDANGAELVKMSYTDKNGKTIEGGYALKAGDKYYAADYDEATGAIKAKTTS

YTAADGTTKTAANQLGGVDGKTEVVTIDGKTYNASKAAGHDFKAQPELAEAAAKTTENPL

QKIDAALAQVDALRSDLGAVQNRFNSAITNLGNTVNNLSEARSRIEDSDYATEVSNMSRA

QILQQAGTSVLAQANQVPQNVLSLLR (SEQ ID NO: 312)

Figure 18

SEQ ID NO: 498 fljB/STF2 amino acid sequence (hinge region underlined)

MAQVINTNSLSLLTQNNLNKSQSALGTAIERLSSGLRINSAKDDAAGQAIANRFTANIKG
LTQASRNANDGISIAQTTEGALNEINNNLQRVRELAVQSANSTNSQSDLDSIQAEITQRL
NEIDRVSGQTQFNGVKVLAQDNTLTIQVGANDGETIDIDLKQINSQTLGLDSLNVQKAYD
VKDTAVTTKAYANNGTTLDVSGLDDAAIKAATGGTNGTASVTGGAVKFDADNNKYFVTIG
GFTGADAAKNGDYEVNVATDGTVTLAAGATKTTMPAGATTKTEVQELKDTPAVVSADAKN
ALIAGGVDATDANGAELVKMSYTDKNGKTIEGGYALKAGDKYYAADYDEATGAIKAKTTS
YTAADGTTKTAANQLGGVDGKTEVVTIDGKTYNASKAAGHDFKAQPELAEAAAKTTENPL
QKIDAALAQVDALRSDLGAVQNRFNSAITNLGNTVNNLSEARSRIEDSDYATEVSNMSRA
QILQQAGTSVLAQANQVPQNVLSLLR

Figure 29

SEQ ID NO: 499 fljB/STF2 nucleic acid sequence (hinge region underlined)

ATGGCACAAGTAATCAACACTAACAGTCTGTCGCTGCTGACCCAGAATAACCTGAACAAA
TCCCAGTCCGCACTGGGCACCGCTATCGAGCGTCTGTCTTCTGGTCTGCGTATCAACAGC
GCGAAAGACGATGCGGCAGGTCAGGCGATTGCTAACCGTTTCACCGCGAACATCAAAGGT
CTGACTCAGGCTTCCCGTAACGCTAACGACGGTATCTCCATTGCGCAGACCACTGAAGGC
GCGCTGAACGAAATCAACAACAACCTGCAGCGTGTGCGTGAACTGGCGGTTCAGTCTGCT
AACAGCACCAACTCCCAGTCTGACCTCGACTCCATCCAGGCTGAAATCACCCAGCGCCTG
AACGAAATCGACCGTGTATCCGGCCAGACTCAGTTCAACGGCGTGAAAGTCCTGGCGCAG
GACAACACCCTGACCATCCAGGTTGGCGCCAACGACGGTGAAACTATCGATATCGATCTG
AAGCAGATCAACTCTCAGACCCTGGGTCTGGACTCACTGAACGTGCAGAAAGCGTATGAT
GTGAAAGATACAGCAGTAACAACGAAAGCTTATGCCAATAATGGTACTACACTGGATGTA
TCGGGTCTTGATGATGCAGCTATTAAAGCGGCTACGGGTGGTACGAATGGTACGGCTTCT
GTAACCGGTGGTGCGGTTAAATTTGACGCAGATAATAACAAGTACTTTGTTACTATTGGT
GGCTTTACTGGTGCTGATGCCGCCAAAAATGGCGATTATGAAGTTAACGTTGCTACTGAC
GGTACAGTAACCCTTGCGGCTGGCGCAACTAAAACCACAATGCCTGCTGGTGCGACAACT
AAAACAGAAGTACAGGAGTTAAAAGATACACCGGCAGTTGTTTCAGCAGATGCTAAAAAT
GCCTTAATTGCTGGCGGCGTTGACGCTACCGATGCTAATGGCGCTGAGTTGGTCAAAATG
TCTTATACCGATAAAAATGGTAAGACAATTGAAGGCGGTTATGCGCTTAAAGCTGGCGAT
AAGTATTACGCCGCAGATTACGATGAAGCGACAGGAGCAATTAAAGCTAAAACTACAAGT
TATACTGCTGCTGACGGCACTACCAAAACAGCGGCTAACCAACTGGGTGGCGTAGACGGT
AAAACCGAAGTCGTTACTATCGACGGTAAAACCTACAATGCCAGCAAAGCCGCTGGTCAT
GATTTCAAAGCACAACCAGAGCTGGCGGAAGCAGCCGCTAAAACCACCGAAAACCCGCTG
CAGAAAATTGATGCCGCGCTGGCGCAGGTGGATGCGCTGCGCTCTGATCTGGGTGCGGTA
CAAAACCGTTTCAACTCTGCTATCACCAACCTGGGCAATACCGTAAACAATCTGTCTGAA
GCGCGTAGCCGTATCGAAGATTCCGACTACGCGACCGAAGTTTCCAACATGTCTCGCGCG
CAGATTCTGCAGCAGGCCGGTACTTCCGTTCTGGCGCAGGCTAACCAGGTCCCGCAGAAC
GTGCTGTCTCTGTTACGT

Figure 30

SEQ ID NO: 500 fljB/STF2Δ amino acid sequence

MAQVINTNSLSLLTQNNLNKSQSALGTAIERLSSGLRINSAKDDAAGQAIANRFTANIKGLT
QASRNANDGISIAQTTEGALNEINNNLQRVRELAVQSANSTNSQSDLDSIQAEITQRLNEID
RVSGQTQFNGVKVLAQDNTLTIQVGANDGETIDIDLKQINSQTLGLDSLNVHGAPVDPASPW
TENPLQKIDAALAQVDALRSDLGAVQNRFNSAITNLGNTVNNLSEARSRIEDSDYATEVSNM
SRAQILQQAGTSVLAQANQVPQNVLSLLR

Figure 31

SEQ ID NO: 501 fljB/STF2Δ nucleic acid sequence

ATGGCACAAGTAATCAACACTAACAGTCTGTCGCTGCTGACCCAGAATAACCTGAACAAATC
CCAGTCCGCACTGGGCACCGCTATCGAGCGTCTGTCTTCTGGTCTGCGTATCAACAGCGCGA
AAGACGATGCGGCAGGTCAGGCGATTGCTAACCGTTTCACCGCGAACATCAAAGGTCTGACT
CAGGCTTCCCGTAACGCTAACGACGGTATCTCCATTGCGCAGACCACTGAAGGCGCGCTGAA
CGAAATCAACAACAACCTGCAGCGTGTGCGTGAACTGGCGGTTCAGTCTGCTAACAGCACCA
ACTCCCAGTCTGACCTCGACTCCATCCAGGCTGAAATCACCCAGCGCCTGAACGAAATCGAC
CGTGTATCCGGCCAGACTCAGTTCAACGGCGTGAAAGTCCTGGCGCAGGACAACACCCTGAC
CATCCAGGTTGGCGCCAACGACGGTGAAACTATCGATATCGATCTGAAGCAGATCAACTCTC
AGACCCTGGGTCTGGACTCACTGAACGTGCATGGAGCGCCGGTGGATCCTGCTAGCCCATGG
ACCGAAAACCCGCTGCAGAAAATTGATGCCGCGCTGGCGCAGGTGGATGCGCTGCGCTCTGA
TCTGGGTGCGGTACAAAACCGTTTCAACTCTGCTATCACCAACCTGGGCAATACCGTAAACA
ATCTGTCTGAAGCGCGTAGCCGTATCGAAGATTCCGACTACGCGACCGAAGTTTCCAACATG
TCTCGCGCGCAGATTTTGCAGCAGGCCGGTACTTCCGTTCTGGCGCAGGCTAACCAGGTCCC
GCAGAACGTGCTGTCTCTGTTACGTG

Figure 32

SEQ ID NO: 502 E. coli fliC amino acid sequence (hinge region underlined)

MAQVINTNSLSLITQNNINKNQSALSSSIERLSSGLRINSAKDDAAGQAIANRFTSNIKG
LTQAARNANDGISVAQTTEGALSEINNNLQRIRELTVQASTGTNSDSDLDSIQDEIKSRL
DEIDRVSGQTQFNGVNVLAKDGSMKIQVGANDGQTITIDLKKIDSDTLGLNGFNVNGSGT
IANKAATISDLTAAKMDAATNTITTTNNALTASKALDQLKDGDTVTIKADAAQTATVYTY
NASAGNFSLSNVSNNTSEKAGDVAASLLPPAGQTASGVYKAASGEVNFDVDANGKITIGG
QKAYLTSDGNLTTNDAGGATAATLDGLFKKAGDGQSIGFKKTASVTMGGTTYNFKTGADA
DAATANAGVSFTDTASKETVLNKVATAKQGKAAAADGDTSATITYKSGVQTYQAVFAAGD
GTASAKYADKADVSNATATYTDADGEMTTIGSYTTKYSIDANNGKVTVDSGTGTGKYAPK
VGAEVYVSANGTLTTDATSEGTVTKDPLKALDEAISSIDKFRSSLGAIQNRLDSAVTNLN
NTTTNLSEAQSRIQDADYATEVSNMSKAQIIQQAGNSVLAKANQVPQQVLSLLQG

Figure 33

SEQ ID NO: 503 E. coli fliC -nucleic acid sequence (hinge region underlined)

ATGGCACAAGTCATTAATACCAACAGCCTCTCGCTGATCACTCAAAATAATATCAACAAG
AACCAGTCTGCGCTGTCGAGTTCTATCGAGCGTCTGTCTTCTGGCTTGCGTATTAACAGC
GCGAAGGATGACGCCGCAGGTCAGGCGATTGCTAACCGTTTTACTTCTAACATTAAAGGC
CTGACTCAGGCTGCACGTAACGCCAACGACGGTATTTCCGTTGCGCAGACCACCGAAGGC
GCGCTGTCCGAAATCAACAACAACTTACAGCGTATCCGTGAACTGACGGTTCAGGCTTCT
ACCGGGACTAACTCCGATTCAGATCTGGACTCCATTCAGGACGAAATCAAATCCCGTCTG
GACGAAATTGACCGCGTATCTGGCCAGACCCAGTTCAACGGCGTGAACGTACTGGCGAAA
GACGGTTCAATGAAAATTCAGGTTGGTGCGAATGACGGCCAGACTATCACGATTGATCTG
AAGAAAATTGACTCAGATACGCTGGGGCTGAATGGTTTTAACGTGAATGGTTCCGGTACG
ATAGCCAATAAAGCGGCGACCATTAGCGACCTGACAGCAGCGAAAATGGATGCTGCAACT
AATACTATAACTACAACAAATAATGCGCTGACTGCATCAAAGGCGCTTGATCAACTGAAA
GATGGTGACACTGTTACTATCAAAGCAGATGCTGCTCAAACTGCCACGGTTTATACATAC
AATGCATCAGCTGGTAACTTCTCACTCAGTAATGTATCGAATAATACTTCAGAAAAAGCA
GGTGATGTAGCAGCTAGCCTTCTCCCGCCGGCTGGGCAAACTGCTAGTGGTGTTTATAAA
GCAGCAAGCGGTGAAGTGAACTTTGATGTTGATGCGAATGGTAAAATCACAATCGGAGGA
CAGAAAGCATATTTAACTAGTGATGGTAACTTAACTACAAACGATGCTGGTGGTGCGACT
GCGGCTACGCTTGATGGTTTATTCAAGAAAGCTGGTGATGGTCAATCAATCGGGTTTAAG
AAGACTGCATCAGTCACGATGGGGGGAACAACTTATAACTTTAAAACGGGTGCTGATGCT
GATGCTGCAACTGCTAACGCAGGGGTATCGTTCACTGATACAGCTAGCAAAGAAACCGTT
TTAAATAAAGTGGCTACAGCTAAACAAGGCAAAGCAGCTGCAGCTGACGGTGATACATCC
GCAACAATTACCTATAAATCTGGCGTTCAGACGTATCAGGCTGTATTTGCCGCAGGTGAC
GGTACTGCTAGCGCAAAATATGCCGATAAAGCTGACGTTTCTAATGCAACAGCAACATAC
ACTGATGCTGATGGTGAAATGACTACAATTGGTTCATACACCACGAAGTATTCAATCGAT
GCTAACAACGGCAAGGTAACTGTTGATTCTGGAACTGGTACGGGTAAATATGCGCCGAAA
GTAGGGGCTGAAGTATATGTTAGTGCTAATGGTACTTTAACAACAGATGCAACTAGCGAA
GGCACAGTAACAAAAGATCCACTGAAAGCTCTGGATGAAGCTATCAGCTCCATCGACAAA
TTCCGTTCTTCCCTGGGTGCTATCCAGAACCGTCTGGATTCCGCAGTCACCAACCTGAAC
AACACCACTACCAACCTGTCCGAAGCGCAGTCCCGTATTCAGGACGCCGACTATGCGACC
GAAGTGTCCAACATGTCGAAAGCGCAGATCATTCAGCAGGCCGGTAACTCCGTGCTGGCA
AAAGCCAACCAGGTACCGCAGCAGGTTCTGTCTCTGCTGCAGGGTTAG

Figure 34

SEQ ID NO: 504 Salmonella muenchen flagellin fliC amino acid sequence (hinge region underlined)

MAQVINTNSLSLLTQNNLNKSQSALGTAIERLSSGLRINSAKDDAAGQAIANRFTANIKGLT
QASRNANDGISIAQTTEGALNEINNNLQRVRELAVQSANGTNSQSDLDSIQAEITQRLNEID
RVSGQTQFNGVKVLAQDNTLTIQVGANDGETIDIDLKEISSKTLGLDKLNVQDAYTPKETAV
TVDKTTYKNGTDTITAQSNTDIQTAIGGGATGVTGADIKFKDGQYYLDVKGGASAGVYKATY
DETTKKVNIDTTDKTPLATAEATAIRGTATITHNQIAEVTKEGVDTTTVAAQLAAAGVTGAD
KDNTSLVKLSFEDKNGKVIDGGYAVKMGDDFYAATYDEKTGTITAKTTTYTDGAGVAQTGAV
KFGGANGKSEVVTATDGKTYLASDLDKHNFRTGGELKEVNTDKTENPLQKIDAALAQVDTLR
SDLGAVQNRFNSAITNLGNTVNNLSSARSRIEDSDYATEVSNMSRAQILQQAGTSVLAQANQ
VPQNVLSLLR

Figure 35

SEQ ID NO: 505 Salmonella muenchen flagellin fliC nucleic acid sequence (hinge region underlined)

AATGGCACAAGTCATTAATACAAACAGCCTGTCGCTGTTGACCCAGAATAACCTGAACAAAT
CCCAGTCCGCTCTGGGCACCGCTATCGAGCGTCTGTCTTCCGGTCTGCGTATCAACAGCGCG
AAAGACGATGCGGCAGGTCAGGCGATTGCTAACCGTTTCACCGCGAACATCAAAGGTCTGAC
TCAGGCTTCCCGTAACGCTAACGACGGTATCTCCATTGCGCAGACCACTGAAGGCGCGCTGA
ACGAAATCAACAACAACCTGCAGCGTGTGCGTGAACTGGCGGTTCAGTCTGCTAACGGTACT
AACTCCCAGTCTGACCTTGACTCTATCCAGGCTGAAATCACCCAGCGTCTGAACGAAATCGA
CCGTGTATCCGGTCAGACTCAGTTCAACGGCGTGAAAGTCCTGGCGCAGGACAACACCCTGA
CCATCCAGGTTGGTGCCAACGACGGTGAAACTATTGATATTGATTTAAAAGAAATTAGCTCT
AAAACACTGGGACTTGATAAGCTTAATGTCCAGGATGCCTACACCCCGAAAGAAACTGCTGT
AACCGTTGATAAAACTACCTATAAAAATGGTACAGATACTATTACAGCCCAGAGCAATACTG
ATATCCAAACTGCAATTGGCGGTGGTGCAACGGGGGTTACTGGGGCTGATATCAAATTTAAA
GATGGTCAATACTATTTAGATGTTAAAGGCGGTGCTTCTGCTGGTGTTTATAAAGCCACTTA
TGATGAAACTACAAAGAAAGTTAATATTGATACGACTGATAAAACTCCGTTAGCAACTGCGG
AAGCTACAGCTATTCGGGGAACGGCCACTATAACCCACAACCAAATTGCTGAAGTAACAAAA
GAGGGTGTTGATACGACCACAGTTGCGGCTCAACTTGCTGCTGCAGGGGTTACTGGTGCCGA
TAAGGACAATACTAGCCTTGTAAAACTATCGTTTGAGGATAAAAACGGTAAGGTTATTGATG
GTGGCTATGCAGTGAAAATGGGCGACGATTTCTATGCCGCTACATATGATGAGAAAACAGGT
ACAATTACTGCTAAAACAACCACTTATACAGATGGTGCTGGCGTTGCTCAAACTGGAGCTGT
GAAATTTGGTGGCGCAAATGGTAAATCTGAAGTTGTTACTGCTACCGATGGTAAAACTTACT
TAGCAAGCGACCTTGACAAACATAACTTCAGAACAGGCGGTGAGCTTAAAGAGGTTAATACA
GATAAGACTGAAAACCCACTGCAGAAAATTGATGCTGCCTTGGCACAGGTTGATACACTTCG
TTCTGACCTGGGTGCGGTACAGAACCGTTTCAACTCCGCTATCACCAACCTGGGCAATACCG
TAAATAACCTGTCTTCTGCCCGTAGCCGTATCGAAGATTCCGACTACGCGACCGAAGTCTCC
AACATGTCTCGCGCGCAGATTCTGCAGCAGGCCGGTACCTCCGTTCTGGCGCAGGCTAACCA
GGTTCCGCAAAACGTCCTCTCTTTACTGCGTTAA

Figure 36

SEQ ID:506 Amino acid sequence of pMT/STF2 (Linker underlined)

MKLCILLAVVAFVGLSLGRSAQVINTNSLSLLTQNNLNKSQSALGTAIERLSSGLRI
NSAKDDAAGQAIANRFTANIKGLTQASRNANDGISIAQTTEGALNEINNNLQRVREL
AVQSANSTNSQSDLDSIQAEITQRLNEIDRVSGQTQFNGVKVLAQDNTLTIQVGAND
GETIDIDLKQINSQTLGLDSLNVQKAYDVKDTAVTTKAYANNGTTLDVSGLDDAAIK
AATGGTNGTASVTGGAVKFDADNNKYFVTIGGFTGADAAKNGDYEVNVATDGTVTLA
AGATKTTMPAGATTKTEVQELKDTPAVVSADAKNALIAGGVDATDANGAELVKMSYT
DKNGKTIEGGYALKAGDKYYAADYDEATGAIKAKTTSYTAADGTTKTAANQLGGVDG
KTEVVTIDGKTYNASKAAGHDFKAQPELAEAAAKTTENPLQKIDAALAQVDALRSDL
GAVQNRFNSAITNLGNTVNNLSEARSRIEDSDYATEVSNMSRAQILQQAGTSVLAQA
NQVPQNVLSLLRKGNSKLEGQLEFPRTSPVWWNSADIQHSGGRSSLEGPRFEGKPIP
NPLLGLDSTRTGHHHHHH

Figure 37

SEQ ID: 507 Amino acid sequence of pMT/STF2 (Linker underlined)

ATGAAGTTATGCATATTACTGGCCGTCGTGGCCTTTGTTGGCCTCTCGCTCGGGAGATCT
GCACAAGTAATCAACACTAACAGTCTGTCGCTGCTGACCCAGAATAACCTGAACAAATCC
CAGTCCGCACTGGGCACCGCTATCGAGCGTCTGTCTTCTGGTCTGCGTATCAACAGCGCG
AAAGACGATGCGGCAGGTCAGGCGATTGCTAACCGTTTCACCGCGAACATCAAAGGTCTG
ACTCAGGCTTCCCGTAACGCTAACGACGGTATCTCCATTGCGCAGACCACTGAAGGCGCG
CTGAACGAAATCAACAACAACCTGCAGCGTGTGCGTGAACTGGCGGTTCAGTCTGCTAAC
AGCACCAACTCCCAGTCTGACCTCGACTCCATCCAGGCTGAAATCACCCAGCGCCTGAAC
GAAATCGACCGTGTATCCGGCCAGACTCAGTTCAACGGCGTGAAAGTCCTGGCGCAGGAC
AACACCCTGACCATCCAGGTTGGCGCCAACGACGGTGAAACTATCGATATCGATCTGAAG
CAGATCAACTCTCAGACCCTGGGTCTGGACTCACTGAACGTGCAGAAAGCGTATGATGTG
AAAGATACAGCAGTAACAACGAAAGCTTATGCCAATAATGGTACTACACTGGATGTATCG
GGTCTTGATGATGCAGCTATTAAAGCGGCTACGGGTGGTACGAATGGTACGGCTTCTGTA
ACCGGTGGTGCGGTTAAATTTGACGCAGATAATAACAAGTACTTTGTTACTATTGGTGGC
TTTACTGGTGCTGATGCCGCCAAAAATGGCGATTATGAAGTTAACGTTGCTACTGACGGT
ACAGTAACCCTTGCGGCTGGCGCAACTAAAACCACAATGCCTGCTGGTGCGACAACTAAA
ACAGAAGTACAGGAGTTAAAAGATACACCGGCAGTTGTTTCAGCAGATGCTAAAAATGCC
TTAATTGCTGGCGGCGTTGACGCTACCGATGCTAATGGCGCTGAGTTGGTCAAAATGTCT
TATACCGATAAAAATGGTAAGACAATTGAAGGCGGTTATGCGCTTAAAGCTGGCGATAAG
TATTACGCCGCAGATTACGATGAAGCGACAGGAGCAATTAAAGCTAAAACTACAAGTTAT
ACTGCTGCTGACGGCACTACCAAAACAGCGGCTAACCAACTGGGTGGCGTAGACGGTAAA
ACCGAAGTCGTTACTATCGACGGTAAAACCTACAATGCCAGCAAAGCCGCTGGTCATGAT
TTCAAAGCACAACCAGAGCTGGCGGAAGCAGCCGCTAAAACCACCGAAAACCCGCTGCAG
AAAATTGATGCCGCGCTGGCGCAGGTGGATGCGCTGCGCTCTGATCTGGGTGCGGTACAA
AACCGTTTCAACTCTGCTATCACCAACCTGGGCAATACCGTAAACAATCTGTCTGAAGCG
CGTAGCCGTATCGAAGATTCCGACTACGCGACCGAAGTTTCCAACATGTCTCGCGCGCAG
ATTCTGCAGCAGGCCGGTACTTCCGTTCTGGCGCAGGCTAACCAGGTCCCGCAGAACGTG
CTGTCTCTGTTACGTAAGGGCAATTCGAAGCTTGAAGGTCAATTGGAATTCCCTAGGACT
AGTCCAGTGTGGTGGAATTCTGCAGATATCCAGCACAGTGGCGGCCGCTCGAGTCTAGAG
GGCCCGCGGTTCGAAGGTAAGCCTATCCCTAACCCTCTCCTCGGTCTCGATTCTACGCGT
ACCGGTCATCATCACCATCACCAT

Figure 38

(SEQ ID NO: 510)

SEQ ID NO: 561

DTICIGYHANNSTDTVDTVLEKNVTVTHSVNLLEDSHNGKLCRLKGIAPLQLGKCNIAGW
LLGNPECDPLLPVRSWSYIVETPNSENGICYPGDFIDYEELREQLSSVSSFERFEIFPKE
SSWPNHNTNGVTAACSHEGKSSFYRNLLWLTEKEGSYPKLKNSYVNKKGKEVLVLWGIHH
PPNSKEQQNLYQNENAYVSVVTSNYNRRFTPEIAERPKVRDQAGRMNYYWTLLKPGDTII
FEANGNLIAPMYAFALSRGFGSGIITSNASMHECNTKCQTPLGAINSSLPYQNIHPVTIG
ECPKYVRSAKLRMVTGLRNIPSIQSRGLFGAIAGFIEGGWTGMIDGWYGYHHQNEQGSGY
AADQKSTQNAINGITNKVNTVIEKMNIQFTAVGKEFNKLEKRMENLNKKVDDGFLDIWTY
NAELLVLLENERTLDFHDSNVKNLYEKVKSQLKNNAKEIGNGCFEFYHKCDNECMESVRN
GTYDYPKYSEESKLNREKVDGVKLESMGIYQ

Figure 43

SEQ ID NO: 562

GACCAGATCTGTATCGGTTATCATGCTAACAATTCTACTGAACAAGTAGATACTATCATG
GAGAAGAACGTTACAGTTACACATGCACAAGATATCCTGGAAAAGAAGCATAATGGAAAA
CTGTGTGACCTTGATGGTGTTAAACCACTAATATTGCGTGACTGCTCAGTTGCTGGGTGG
TTGTTGGGGAATCCAATGTGCGACGAATTTATCAACGTTCCAGAATGGAGTTACATTGTT
GAAAAAGCTAACCCTGTTAACGACTTGTGTTACCCAGGCGATTTTAATGACTACGAGGAA
CTTAAGCATTTGTTGTCAAGAATTAACCACTTCGAGAAAATTCAAATTATTCCAAAGTCA
TCTTGGTCCTCCCATGAAGCATCCCTAGGAGTCTCTTCCGCTTGCCCTTACCAAGGCAAG
AGTTCCTTTTTTCGTAATGTCGTCTGGCTGATCAAAAAGAACTCCACCTATCCAACTATA
AAGAGATCATACAACAACACAAATCAGGAGGATCTGCTAGTTCTGTGGGGCATTCACCAC
CCCAATGACGCAGCTGAGCAGACTAAATTGTACCAAAACCCAACTACCTATATATCAGTT
GGTACCTCAACTCTTAACCAGCGACTAGTCCCCCGTATTGCTACTAGGTCAAAGGTTAAT
GGTCAAAGTGGACGAATGGAGTTTTTCTGGACTATTTTGAAGCCCAACGATGCCATCAAC
TTCGAAAGTAATGGAAATTTCATAGCCCCTGAGTACGCTTACAAAATCGTTAAAAAGGGT
GATTCCACTATCATGAAATCTGAACTGGAATACGGAAACTGTAACACCAAATGCCAGACG
CCAATGGGTGCCATCAACTCTTCTATGCCTTTTCACAACATTCATCCTTTGACTATTGGT
GAATGCCCAAAGTACGTCAAATCTAACCGTTTGGTGTTGGCTACTGGTCTAAGGAACTCC
CCTCAGCGTGAAAGAAGAAGAAAGAAGAGGGGATTATTCGGTGCTATCGCTGGATTTATT
GAGGGAGGATGGCAGGGAATGGTCGATGGCTGGTATGGTTACCATCACTCAAATGAACAG
GGAAGTGGATACGCAGCTGATAAAGAATCTACTCAAAAGGCTATCGACGGTGTTACAAAC
AAGGTCAATTCTATTATCGATAAGATGAATACACAGTTTGAGGCTGTTGGTAGAGAGTTC
AATAATCTTGAGAGAAGAATCGAAAACCTGAACAAGAAAATGGAAGACGGATTTTTAGAT
GTATGGACTTACAATGCTGAGTTGTTGGTCTTGATGGAGAATGAACGAACGTTGGACTTC
CATGACTCCAATGTGAAGAACCTATATGACAAAGTGAGGCTGCAACTTAGAGACAACGCC
AAGGAATTGGGAAACGGGTGCTTCGAGTTTTACCACAAATGCGACAACGAATGTATGGAA
TCAGTGAGAAACGGTACCTATGATTACCCCCAATATTCCGAGGAGGCAAGACTGAAGAGA
GAAGAGATATCTGGTGTAAAGTTGGAATCCATCGGTATTTATCAGATTCTATCTATATAT
TCTACCTAATAG

Figure 44

SEQ ID NO: 563 E. coli fliC Amino Acid sequence (without hinge region)

MAQVINTNSLSLITQNNINKNQSALSSSIERLSSGLRINSAKDDAAGQAIANRFTSNIKG
LTQAARNANDGISVAQTTEGALSEINNNLQRIRELTVQASTGTNSDSDLDSIQDEIKSRL
DEIDRVSGQTQFNGVNVLAKDGSMKIQVGANDGQTITIDLKKIDSDTLGTKDPLKALDEA
ISSIDKFRSSLGAIQNRLDSAVTNLNNTTTNLSEAQSRIQDADYATEVSNMSKAQIIQQA
GNSVLAKANQVPQQVLSLLQG

Figure 45

SEQ ID: 585 Amino acid sequence of pMT/STF2Δ

MKLCILLAVVAFVGLSLGRSAQVINTNSLSLLTQNNLNKSQSALGTAIERLS
SGLRINSAKDDAAGQAIANRFTANIKGLTQASRNANDGISIAQTTEGALNEI
NNNLQRVRELAVQSANSTNSQSDLDSIQAEITQRLNEIDRVSGQTQFNGVKV
LAQDNTLTIQVGANDGETIDIDLKQINSQTLGLDSLNVHGAPVDPASPWTEN
PLQKIDAALAQVDALRSDLGAVQNRFNSAITNLGNTVNNLSEARSRIEDSDY
ATEVSNMSRAQILQQAGTSVLAQANQVPQNVLSLLREFSRYPAQWRPLTRTG
HHHHHH

Figure 46

SEQ ID: 586 Nucleic acid sequence of pMT/STF2Δ

ATGAAGTTATGCATATTACTGGCCGTCGTGGCCTTTGTTGGCCTCTCGCTCG
GGAGATCTGCACAAGTAATCAACACTAACAGTCTGTCGCTGCTGACCCAGAA
TAACCTGAACAAATCCCAGTCCGCACTGGGCACCGCTATCGAGCGTCTGTCT
TCTGGTCTGCGTATCAACAGCGCGAAAGACGATGCGGCAGGTCAGGCGATTG
CTAACCGTTTCACCGCGAACATCAAAGGTCTGACTCAGGCTTCCCGTAACGC
TAACGACGGTATCTCCATTGCGCAGACCACTGAAGGCGCGCTGAACGAAATC
AACAACAACCTGCAGCGTGTGCGTGAACTGGCGGTTCAGTCTGCTAACAGCA
CCAACTCCCAGTCTGACCTCGACTCCATCCAGGCTGAAATCACCCAGCGCCT
GAACGAAATCGACCGTGTATCCGGCCAGACTCAGTTCAACGGCGTGAAAGTC
CTGGCGCAGGACAACACCCTGACCATCCAGGTTGGCGCCAACGACGGTGAAA
CTATCGATATCGATCTGAAGCAGATCAACTCTCAGACCCTGGGTCTGGACTC
ACTGAACGTGCATGGAGCGCCGGTGGATCCTGCTAGCCCATGGACCGAAAAC
CCGCTGCAGAAAATTGATGCCGCGCTGGCGCAGGTGGATGCGCTGCGCTCTG
ATCTGGGTGCGGTACAAAACCGTTTCAACTCTGCTATCACCAACCTGGGCAA
TACCGTAAACAATCTGTCTGAAGCGCGTAGCCGTATCGAAGATTCCGACTAC
GCGACCGAAGTTTCCAACATGTCTCGCGCGCAGATTTTGCAGCAGGCCGGTA
CTTCCGTTCTGGCGCAGGCTAACCAGGTCCCGCAGAACGTGCTGTCTCTGTT
ACGTGAATTCTCTAGATATCCAGCACAGTGGCGGCCGCTCACGCGTACCGGT
CATCATCACCATCACCATTGA

Figure 47

SEQ ID NO: 595 Salmonella muenchen fliC Amino Acid Sequence (Hinge region deleted)

MAQVINTNSLSLLTQNNLNKSQSALGTAIERLSSGLRINSAKDDAAGQAIANRFTANIKG
LTQASRNANDGISIAQTTEGALNEINNNLQRVRELAVQSANGTNSQSDLDSIQAEITQRL
NEIDRVSGQTQFNGVKVLAQDNTLTIQVGANDGETIDIDLKEISSKTLDKHNFRTGGELK
EVNTDKTENPLQKIDAALAQVDTLRSDLGAVQNRFNSAITNLGNTVNNLSSARSRIEDSD
YATEVSNMSRAQILQQAGTSVLAQANQVPQNVLSLLR

Figure 48

SEQ ID NO: 596 Salmonella Muenchen fliC Nucleic Acid Sequence (Hinge region deleted)

ATGGCACAAGTCATTAATACAAACAGCCTGTCGCTGTTGACCCAGAATAACCTGAACAAA
TCCCAGTCCGCTCTGGGCACCGCTATCGAGCGTCTGTCTTCCGGTCTGCGTATCAACAGC
GCGAAAGACGATGCGGCAGGTCAGGCGATTGCTAACCGTTTCACCGCGAACATCAAAGGT
CTGACTCAGGCTTCCCGTAACGCTAACGACGGTATCTCCATTGCGCAGACCACTGAAGGC
GCGCTGAACGAAATCAACAACAACCTGCAGCGTGTGCGTGAACTGGCGGTTCAGTCTGCT
AACGGTACTAACTCCCAGTCTGACCTTGACTCTATCCAGGCTGAAATCACCCAGCGTCTG
AACGAAATCGACCGTGTATCCGGTCAGACTCAGTTCAACGGCGTGAAAGTCCTGGCGCAG
GACAACACCCTGACCATCCAGGTTGGTGCCAACGACGGTGAAACTATTGATATTGATTTA
AAAGAAATTAGCTCTAAAACACTGACAGATAAGACTGAAAACCCACTGCAGAAAATTGAT
GCTGCCTTGGCACAGGTTGATACACTTCGTTCTGACCTGGGTGCGGTACAGAACCGTTTC
AACTCCGCTATCACCAACCTGGGCAATACCGTAAATAACCTGTCTTCTGCCCGTAGCCGT
ATCGAAGATTCCGACTACGCGACCGAAGTCTCCAACATGTCTCGCGCGCAGATTCTGCAG
CAGGCCGGTACCTCCGTTCTGGCGCAGGCTAACCAGGTTCCGCAAAACGTCCTCTCTTTA
CTGCGTTAA

Figure 49

Figure 70
STF2Δ.EIIIs+
OD. 450
2
1.8
1.6
1.4
1.2
1
0.8
0.6
0.4
0.2
Neg Ctrl
Pos Ctrl
E2-21
E27
E28
E29
E30
E31
E32
E33
E34
E35
E36
E37
E38
E39
E40
E41
E42
E43
E44
E45
E46
E47
E48
E49
E50
E51
E52
Peptide

Flavivirus Envelope Protein Domain I/III junction
(domain I 280-297, domain III 298-406)

WN aa 281-307

| | | |
|---|---|---|
| WN | LTSGHLKCRVKMEKLQLKGTTYGVCSK | (SEQ ID NO: 691) |
| JE | LTSGHLKCRLKMDKLALKGTTYGMCTE | (SEQ ID NO: 692) |
| D1 | IFAGHLKCRLKMDKLTLKGMSYVMCTG | (SEQ ID NO: 639) |
| D2 | LFTGHLKCRLRMDKLQLKGMSYSMCTG | (SEQ ID NO: 694) |
| D3 | IFAGHLKCRLKMDKLKLKGMSYAMCLN | (SEQ ID NO: 695) |
| D4 | MFAGHLKCKVRMEKLRIKGMSYTMCSG | (SEQ ID NO: 696) |
| | xxxGHLKCRxxMxKLxLKGxxYxxCxx | (SEQ ID NO: 697) |
| | GHLKCRMKLLKGYC | (SEQ ID NO: 698) |

Figure 73

(SEQ ID NO: 842)

Flagellin (1UCU)

Flagellin from Pseudomonas aeruginosa (accession number P21184)

```
        10         20         30         40 *        50         60
ALTVNTNIAS LNTQRNLNNS SASLNTSLQR LSTGSRINSA KDDAAGLQIA NRLTSQVNGL

    *   70         80         90        100        110        *   *
NVATKNANDG ISLAQTAEGA LQQSTNILQR MRDLSLQSAN GSNSDSERTA LNGEVKQLQK

       130        * 140        150        160        170      * 180
ELDRISNTTT FGGRKLLDGS FGVASFQVGS AANEIISVGI DEMSAESLNG TYFKADGGGA

       190        200     *    *          *       230        240
VTAATASGTV DIAIGITGGS AVNVKVDMKG NETAEQAAAK IAAAVNDANV GIGAFSDGDT

     *  *         260        270        280       *290      *  300
ISYVSKAGKD GSGAITSAVS GVVIADTGST GVGTAAGVTP SATAFAKTND TVAKIDISTA

*      310      * 320        330          *        350        360
KGAQSAVLVI DEAIKQIDAQ RADLGAVQNR FDNTINNLKN IGENVSAARG RIEDTDFAAE

     * 370        380        390
TANLTKNQVL QQAGTAILAQ ANQLPQSVLS LLR  (SEQ ID NO: 815)
```

Figure 78

STF2 sequence

```
        10          *          30         40  *      50          *
MAQVINTNSL SLLTQNNLNK SQSALGTAIE RLSSGLRINS AKDDAAGQAI ANRFTANIKG

        70         80         90        100        110        120
LTQASRNAND GISIAQTTEG ALNEINNNLQ RVRELAVQSA NSTNSQSDLD SIQAEITQRL

       130      * 140        150        160 *      170       *180
NEIDRVSGQT QFNGVKVLAQ DNTLTIQVGA NDGETIDIDL KQINSQTLGL DSLNVQKAYD

 *      *        200          *        220       *        *  240
VKDTAVTTKA YANNGTTLDV SGLDDAAIKA ATGGTNGTAS VTGGAVKFDA DNNKYFVTIG

        *        260        270 *      280 *      *           *
GFTGADAAKN GDYEVNVATD GTVTLAAGAT KTTMPAGATT KTEVQELKDT PAVVSADAKN

       310          *      *  *        *340 *      350       * *360
ALIAGGVDAT DANGAELVKM SYTDKNGKTI EGGYALKAGD KYYAADYDEA TGAIKAKTTS

        *                 *      *       * 400  *     410       *  420
YTAADGTTKT AANQLGGVDG KTEVVTIDGK TYNASKAAGH DFKAQPELAE AAAKTTENPL

 *     430        440        450        460        470        480
QKIDAALAQV DALRSDLGAV QNRFNSAITN LGNTVNNLSE ARSRIEDSDY ATEVSNMSRA

       490
QILQQAGTSV LAQANQVPQN VLSLLR  (SEQ ID NO: 816)
```

Figure 79

Flagellin from Listeria monocytogenes (accession number Q92DW3)

```
 *       10 *       *20          30    *    40          50      *   60
MKVNTNIISL KTQEYLRKNN EGMTQAQERL ASGKRINSSL DDAAGLAVVT RMNVKSTGLD

    *    70         80          90         100          *          *
AASKNSSMGI DLLQTADSAL SSMSSILQRM RQLAVQSSNG SFSDEDRKQY TAEFGSLIKE

       130    *   140         150    *   160        *170         180
LDHVADTTNY NNIKLLDQTA TNAATQVSIQ ASDKANDLIN IDLFNAKGLS AGTITLGSGS

       190        200         210         220        230           *
TVAGYSALSV ADADSSQEAT EAIDELINNI SNGRALLGAG MSRLSYNVSN VNNQSIATKA

       250          *  *      270         280
SASSIEDADM AAEMSEMTKY KILTQTSISM LSQANQTPQM LTQLINS  (SEQ ID NO: 820)
```

Figure 80

COMPOSITIONS THAT INCLUDE HEMAGGLUTININ

RELATED APPLICATIONS

This application claims the benefit of U.S. Provisional Application Nos. 60/779,854, filed on Mar. 7, 2006; 60/784,497, filed on Mar. 20, 2006; 60/790,457, filed on Apr. 7, 2006; 60/814,292, filed on Jun. 16, 2006; 60/830,881, filed on Jul. 14, 2006; 60/838,007, filed on Aug. 16, 2006; and 60/856,451, filed on Nov. 3, 2006. The entire teachings of the above applications are incorporated herein by reference.

BACKGROUND OF THE INVENTION

Viral influenza infection can lead to disease. Strategies to prevent and manage disease associated with viral influenza infection can include vaccines with inactivated viruses and drugs. However, such strategies can be costly to maintain supply with demand and, thus, be limited in supply; may result in variable protection and less than satisfactory alleviation of symptoms, thereby ineffectively preventing or treating illness and, in some instances death, consequent to disease associated with viral influenza infection. Thus, there is a need to develop new, improved and effective methods of treatment for preventing and managing disease associated with viral influenza infection.

SUMMARY OF THE INVENTION

The present invention relates to compositions, such as compositions that stimulate a protective immune response, and methods of making proteins that stimulate a protective immune response in a subject.

In one embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transforming a nucleic acid sequence encoding the protein portion into a prokaryotic host cell; and culturing the prokaryotic host cell to thereby make the protein that stimulates a protective immune response in a subject.

In another embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is not a *Pichia pastoris* eukaryotic host cell; and culturing the eukaryotic host cell to thereby make the protein that stimulates a protective immune response in a subject.

In another embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is not a *Drosophila melanogaster* eukaryotic host cell; and culturing the eukaryotic host cell to thereby make the protein that stimulates a protective immune response in a subject.

In a further embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is not an insect eukaryotic host cell; and culturing the eukaryotic host cell to thereby make the protein that stimulates a protective immune response in a subject.

In a further embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is not a stably transformed insect host cell; and culturing the eukaryotic host cell to thereby make the protein that stimulates a protective immune response in a subject.

In still another embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is neither a *Picia pastoris* eukaryotic host cell nor a stably transfected insect host cell; and culturing the eukaryotic host cell to thereby make the protein that stimulates a protective immune response in a subject.

In yet another embodiment, the invention is a method of stimulating protective immunity in a subject, comprising the step of administering to the subject a composition that includes a protein made by a method comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transforming a nucleic acid sequence encoding the portion into a prokaryotic host cell; and culturing the prokaryotic host cell to thereby make the protein that stimulates a protective immune response in a subject.

In an additional embodiment, the invention is a method of stimulating protective immunity in a subject, comprising the step of administering to the subject a composition that includes a protein portion of a naturally occurring viral hemagglutinin, wherein the protein portion includes at least a portion of a globular head, and at least a portion of one secondary structure that causes the globular head to essentially retain its tertiary structure and wherein the protein portion lacks a membrane fusion domain, a transmembrane domain and a cytoplasmic domain.

In still another embodiment, the invention is a method of making a viral hemagglutinin protein that stimulates a protective immune response in a subject, comprising the steps of separating a portion of a protein from a naturally occurring viral hemagglutinin to thereby form a protein portion, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the portion in a eukaryotic host cell, wherein the eukaryotic host cell is neither a *Pichia pastoris* a eukaryotic host cell nor a stably transfected insect host cell; and culturing the eukaryotic host cell to thereby make the protein that stimulates a protective immune response in a subject.

In another embodiment, the invention is a method of making a protein that stimulates a protective immune response in a subject, comprising the steps of separating a portion of a protein from a naturally occurring viral hemagglutinin to thereby make a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; infecting a nucleic acid sequence encoding the protein portion into an insect cell host cell; and culturing the insect host cell to thereby make the protein that stimulates a protective immune response in a subject.

In another embodiment, the invention is a method of making a viral hemagglutinin protein that stimulates a protective immune response in a subject, comprising the steps of transforming a prokaryotic host cell with a nucleic acid sequence encoding at least one viral hemagglutinin that lacks a transmembrane domain and a cytoplasmic domain; and culturing the prokaryotic cell to thereby make the protein.

In a further embodiment, the invention is a method of stimulating protective immunity in a subject, comprising the step of administering to the subject a composition that includes a protein made by a method comprising the steps of transforming a prokaryotic host cell with a nucleic acid sequence encoding at least one viral hemagglutinin that lacks a transmembrane domain and a cytoplasmic domain; and culturing the prokaryotic host cell to thereby make the protein.

In another embodiment, the invention is a method of stimulating protective immunity in a subject, comprising the step of administering to the subject a composition that includes a protein having at least one viral hemagglutinin that lacks a transmembrane domain and a cytoplasmic domain, wherein the protein was expressed in a prokaryotic cell.

In an additional embodiment, the invention is a composition comprising at least a portion of at least one pathogen-associated molecular pattern and a portion of a protein of a naturally occurring viral hemagglutinin, wherein the portion of the naturally occurring viral hemagglutinin includes at least a portion of a globular head and at least a portion of at least one secondary structure that causes the globular head to essentially retain its tertiary structure, and wherein the portion of the naturally occurring viral hemagglutinin lacks a membrane fusion domain, a transmembrane domain, and a cytoplasmic domain.

Another embodiment of the invention is a composition comprising a flagellin component that is at least a portion of a flagellin, wherein the flagellin component includes at least one cysteine residue and whereby the flagellin component activates a Toll-like Receptor 5.

In still another embodiment, the invention is a composition comprising a Toll-like Receptor agonist component that is at least a portion of a Toll-like Receptor agonist, wherein the Toll-like Receptor agonist component includes at least one cysteine residue in a position where a cysteine residue does not occur in the native Toll-like Receptor agonist, whereby the Toll-like Receptor agonist component activates a Toll-like Receptor.

In an additional embodiment, the invention is a composition comprising a flagellin component that is at least a portion of a flagellin, wherein at least one lysine of the flagellin component has been substituted with at least one arginine, whereby the flagellin component activates a Toll-like Receptor 5.

In yet another embodiment, the invention is a composition comprising a flagellin component that is at least a portion of a flagellin, wherein at least one lysine of the flagellin component has been substituted with at least one serine residue, whereby the flagellin component activates a Toll-like Receptor 5.

Another embodiment of the invention is a composition comprising a flagellin component that is at least a portion of a flagellin, wherein at least one lysine of the flagellin component has been substituted with at least one histidine residue, whereby the flagellin component activates a Toll-like Receptor 5.

A further embodiment of the invention is a method of stimulating an immune response in a subject, comprising the step of administering to the subject a composition that includes a flagellin component that is at least a portion of a flagellin, wherein the flagellin component includes at least one cysteine residue and whereby the flagellin component activates a Toll-like Receptor 5.

In still another embodiment, the invention is a method of stimulating an immune response in a subject, comprising the step of administering to the subject a composition that includes a flagellin component that is at least a portion of a flagellin, wherein at least one lysine of the flagellin component has been substituted with at least one arginine, whereby the flagellin component activates a Toll-like Receptor 5.

An additional embodiment of the invention is a method of stimulating an immune response in a subject, comprising the step of administering to the subject a composition that includes a flagellin component that is at least a portion of a flagellin, wherein at least one lysine of the flagellin component has been substituted with at least one serine residue, whereby the flagellin component activates a Toll-like Receptor 5.

In another embodiment, the invention is a method of stimulating an immune response in a subject, comprising the step of administering to the subject a composition that includes a flagellin component that is at least a portion of a flagellin, wherein at least one lysine of the flagellin component has been substituted with at least one histidine residues whereby the flagellin component activates a Toll-like Receptor 5.

In yet another embodiment, the invention is a method of stimulating an immune response in a subject, comprising the step of administering to the subject a composition that includes a Toll-like Receptor agonist component that is at least a portion of a Toll-like Receptor agonist, wherein the Toll-like Receptor agonist component includes at least one cysteine residue in a position where a cysteine residue does not occur in the native Toll-like Receptor agonist, whereby the Toll-like Receptor agonist component activates a Toll-like Receptor agonist.

The methods and composition of the invention can be employed to stimulate an immune response, in particular, a protective immune response, in a subject. Advantages of the claimed invention include, for example, cost effective methods and compositions that can be produced in relatively large quantities for use in the prevention and treatment of disease associated with viral influenza infection. The claimed methods and compositions can be employed to prevent or treat viral influenza infection and, therefore, avoid serious illness and death consequent to viral influenza infection.

BRIEF DESCRIPTION OF THE FIGURES

FIG. 18 depicts the amino acid sequence of full-length flagellin (STF2) (SEQ ID NO: 312) highlighting important domains and residues. Gray=experimentally-defined TLR5 binding site (Smith, et al., 2003); K=lysine residues; underline=flagellin sequences corresponding to STF2Δ construct (linker not shown).

FIG. 29 depicts the amino acid sequence of *Salmonella typhimurium* flagellin type 2 (fljB/STF2) with the hinge region underlined (SEQ ID NO: 498).

FIG. 30 depicts the nucleic acid sequence (SEQ ID NO: 499) encoding SEQ ID NO: 498. The nucleic acid sequence encoding the hinge region is underlined.

FIG. 31 depicts the amino acid sequence of fljB/STF2 without the hinge region (also referred to herein as "fljB/STF2Δ" or "STF2Δ") (SEQ ID NO: 500).

FIG. 32 depicts the nucleic acid sequence (SEQ ID NO: 501) encoding SEQ ID NO: 500.

FIG. 33 depicts the amino acid sequence of *E. coli* flagellin fliC (also referred to herein as "*E. coli* fliC") with the hinge region underlined (SEQ ID NO: 502).

FIG. 34 depicts the nucleic acid sequence (SEQ ID NO: 503) encoding SEQ ID NO: 502. The nucleic acid sequence encoding the hinge region is underlined.

FIG. 35 depicts the amino acid sequence of *S. muenchen* flagellin fliC (also referred to herein as "*S. muenchen* fliC") with the hinge region underlined (SEQ ID NO: 504).

FIG. 36 depicts the nucleic acid sequence (SEQ ID NO: 505) encoding SEQ ID NO:504. The nucleic acid sequence encoding the hinge region is underlined.

FIG. 37 depicts the amino acid sequence of pMT/STF2. The linker is underlined and the sequence of the BiP secretion signal is bolded (SEQ ID NO: 506).

FIG. 38 depicts the nucleic acid sequence (SEQ ID NO: 507) of SEQ ID NO: 506. The nucleic acid sequence encoding the linker is underlined and the nucleic acid sequence encoding the BiP sequence is bolded.

FIG. 43 depicts the amino acid sequence (SEQ ID NO: 561) of HA (PR8).

FIG. 44 depicts the nucleic acid sequence (SEQ ID NO: 562) encoding SEQ ID NO: 561.

FIG. 45 depicts the amino acid sequence SEQ ID NO: 563) of *E. Coli* fliC without the hinge region.

FIG. 46 depicts the amino acid sequence of pMT/STF2Δ (SEQ ID NO: 585). The linker sequence is underlined and the BiP secretion signal is bolded.

FIG. 47 depicts the nucleic acid sequence (SEQ ID NO: 586) encoding SEQ ID NO: 585. The nucleic acid sequence encoding the linker is underlined and the nucleic acid sequence encoding the BiP secretion signal is bolded.

FIG. 48 depicts the amino acid sequence (SEQ ID NO: 595) of the *Salmonella muenchen* fliC without the hinge region, which is also referred to herein as "*S. muenchen* fliCΔ."

FIG. 49 depicts the nucleic acid sequence of *Salmonella muenchen* fliC (SEQ ID NO: 596) encoding SEQ ID NO: 595:

FIG. 73 depicts the amino acid sequences (SEQ ID NOS: 691-698) of the EI/EIII junction for West Nile, Japanese encephalitis and Dengue (serotypes 1 through 4) viruses. The West Nile epitope identified using antisera from STF2Δ.EIIIs+ immunized animals is underlined. This sequence corresponds to peptide E2-21 (SEQ ID NO: 728).

FIG. 78 depicts the amino acid sequence of *Pseudomonas aeruginosa* flagellin (SEQ ID NO: 815). Lysine residues are indicated by the asterisks.

FIG. 79 depicts the amino acid sequence of a *S. typhimurium* flagellin (SEQ ID NO: 816). Lysine residues are indicated by the asterisks.

FIG. 80 depicts the amino acid sequence (SEQ ID NO: 820) of *Listeria monocytogenes* flagellin (GenBank Accession No: Q92DW3). Lysine residues are indicated by the asterisks.

DETAILED DESCRIPTION OF THE INVENTION

Figure 1:
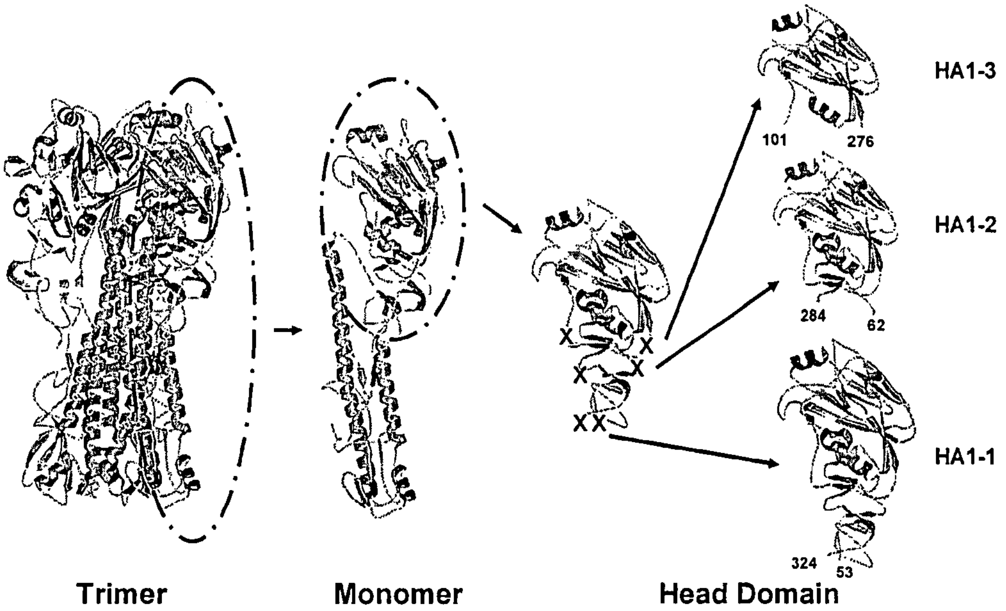
FIG. 1 depicts a ribbon diagram of PR8 influenza A hemagglutin (HA) crystal structure (1RU7). Schematically presentations from left to right are HA trimer, monomer, the globular head domain and the three choices of vaccine candidates. Molecules or domains of interest are highlighted by dotted circle, such as the monomer in trimer structure and the globular head domain within the monomer structure. The domain boundaries of three vaccine candidates are marked by the cross signs. The residue numbers of each selection are also labeled in the individual vaccine presentation.

The features and other details of the invention, either as steps of the invention or as combinations of parts of the invention, will now be more particularly described and pointed out in the claims. It will be understood that the particular embodiments of the invention are shown by way of illustration and not as limitations of the invention. The principle features of this invention can be employed in various embodiments without departing from the scope of the invention.

The invention generally is directed to methods of making compositions, and to compositions, that stimulate an immune response in a subject, such as a protective immune response, and methods of treatment, such as by administering the composition to a subject.

"Stimulating an immune response," as used herein, refers to the generation of antibodies and/or T-cells to at least a portion of an antigen, such as the protein portions of hemagglutinin (HA) (e.g., HA1-1, HA1-2 proteins) described herein. The antibodies and/or T-cells can be generated to at least a portion of an influenza viral protein (e.g., HA and M2 proteins of influenza A, B and/or C).

Stimulating an immune response in a subject can include the production of humoral and/or cellular immune responses that are reactive against the antigen, such as a viral protein, in particular, an influenza viral protein.

The compositions of the invention for use in methods to stimulate immune responses in subjects, can be evaluated for the ability to stimulate an immune response in a subject using well-established methods. Exemplary methods to determine whether the compositions of the invention stimulate an immune response in a subject, include measuring the production of antibodies specific to the antigen (e.g., IgG antibodies) by a suitable technique such as, ELISA assays; the potential to induce antibody-dependent enhancement (ADE) of a secondary infection; macrophage-like assays; neutralization assessed by using the Plaque Reduction Neutralization Test ($PRNT_{80}$); and the ability to generate serum antibodies in non-human models (e.g., mice, rabbits, monkeys) (Putnak, et al. *Vaccine* 23:4442-4452 (2005)).

"Stimulates a protective immune response," as used herein, means administration of the compositions of the invention, such as hemagglutinin (HA) proteins (e.g., HA1-1, HA1-2 proteins described herein), results in production of antibodies to the protein to thereby cause a subject to survive challenge by an otherwise lethal dose of a viral protein, such as viral HA. Techniques to determine a lethal dose of a virus (e.g., an influenza virus) are known to one of skill in the art (see, for example, WHO/CDS/CSR/NCS2002.5 "WHO Manual on Animal Influenza Diagnosis and Surveillance" World Health Organization, Dept of Communicable Disease Surveillance and Response, WHO Global Influenza Programme; Harmon, M. W., et al., *J. Clin. Microbiol.* 26:333-337 (1988); Reed, L. J., et al., *Am. J. Hyg* 27:493-497 (1938); Rose, T., et al., *J. Clin. Microbiol.* 37:937-943 (1999); Walls, H. H. et al., *J. Clin. Microbiol.* 23:240-245 (1986); Current Protocols in Immunology, 19.11.1-19.11.32, Cottey, R., et al., John Wiley & Sons, Inc (2001)). Exemplary techniques for determining a lethal dose can include administration of varying doses of virus and a determination of the percent of subjects that survive following administration of the dose of virus (e.g., $LD_{10}$, $LD_{20}$, $LD_{40}$, $LD_{50}$, $LD_{60}$, $LD_{70}$, $LD_{80}$, $LD_{90}$). For example, a lethal dose of a virus that results in the death of 50% of a population of subjects is referred to as an "$LD_{50}$"; a lethal dose of a virus that results in the death of 80% of a population of subjects is referred to herein as "$LD_{80}$"; a lethal dose of a virus that results in death of 90% of a population of subjects is referred to herein as "$LD_{90}$."

For example, determination of the $LD_{90}$ can be conducted in subjects (e.g., mice) by administering intranasally varying doses (e.g., dilutions, such as log and half-log dilutions of $8\times10^3$ egg-infectious doses (EID)) followed by an assessment of the survival of the subjects about 14 days to about 21 days after infection with the virus. Protective immunity can be assessed by physical appearance of the subject, general demeanor (active), weight (initial loss of weight followed by return to a weight about the weight of the subject prior to infection with the virus) and survival after about 14 to about 21 days following infection with the virus.

Assessment of stimulation of protective immunity can also be made by employing assays that assess the ability of the antibodies produced in response to the compositions of the invention (e.g., a portion of the protein of the naturally occurring virus, such as a protein portion of hemagglutinin) to neutralize binding, of the viral protein (e.g., hemagglutinin protein) to a host cell (see, for example, Current Protocols in Immunology, 19.11.1-19.11.32, Cottey, R., et al., John Wiley & Sons, Inc (2001)). Assessment of stimulation of protective immunity can also be made by employing assays that measure the ability of antibodies to inhibit hemagglutinin binding (see, for example, Burnett, F. M. et al., *J. exp. Biol. Med. Sci.* 25:227-233 (1947); Salk, J. E. *J. Immunol.* 49:87-98 (1944); Current Protocols in Immunology, 19.11.1-19.11.32, Cottey, R., et al., John Wiley & Sons. Inc (2001)).

It is believed that inhibition of hemagglutinin binding is indicative of the ability of antibodies, formed from the compositions and by the methods of the invention, to neutralize the sialic acid binding sites of the naturally occurring viral hemagglutinin ("neutralization of HA binding") and, thereby, prevent infection of the host cell as a consequence of stimulating a protective immune response. Inhibition or neutralization of hemagglutinin binding is believed to correlate with an ability of an immune response to protect against a lethal dose of virus.

Neutralization of HA binding can be assessed by in vitro assays (See, for example, Current Protocols in Immunology 19.11.1-19.11.32, Cottey, R., et al., Suppl. 42, John Wiley & Sons, Inc. (2001) and WHO Manual on Animal Influenza Diagnosis and Surveillance. Webster, R., et al., pages 28-36, 48-54, 82-92 (2002)). Exemplary viral neutralization assays rely on the ability of serum to specifically bind and prevent replication of influenza virus in culture, such as in the Madin-Darby Canine Kidney (MDCK) cell line. Briefly, cells are cultured in 96 well plates in the presence of a previously titered virus and the cytopathic effect of the replicating virus is observed under a microscope. To test serum, serial dilutions of the serum are prepared and preincubated with the viral stock for 2 hours at 37° C. prior to infecting the MDCK cells. The mixture is incubated for an additional 2 hours after which the virus/serum mixture is removed and replaced with fresh media. The cells are grown for 4 days. Wells are scored as positive for viral growth if at least about 50% of the cells are dead in at least about half of the wells for a given serum dilution. The reciprocal of the highest dilution of serum which protects at least about half of the cells from death, in at least about half of the wells, is considered the neutralization titer.

Alternatively, a micro-neutralization in vitro assay can be performed to assess neutralization of HA binding. For example, serum is diluted and preincubated with a known titer of virus and mixed with MDCK cells, as described above. After 2 days of incubation, cells are washed and fixed with acetone. The plates are developed as an ELISA using a monoclonal antibody to the influenza nuclear antigen NP. A microneutralization titer is determined as the reciprocal of the highest dilution which yields less than about 50% of the anti-NP reading of the virus-only control wells.

The Hemagglutination Inhibition (HA1) assay is based on the HA antigen on the surface of the influenza virus agglutinating red blood cells (RBC) and preventing red blood cells from precipitating. Antibodies that specifically bind the sialic acid-binding regions of HA prevent agglutination allowing precipitation. The assay is performed in 96 well V bottom plates with fresh chicken RBC. A stock of viral antigen is titered so that about a 4-fold excess of antigen is present relative to the minimum amount needed to prevent precipitation. The test serum, which can be from several species including mouse, ferret, poultry or human, is heated to about 56° C. to inactivate complement. Serial 2-fold dilutions of the inactivated serum are performed and mixed with the stock HA. After about 30 minutes at room temperature, the RBCs are added and the plate is incubated for about 30 to about 45 minutes. Results are scored by observations: agglutination results in cloudy wells while inhibition results in a "button" of red cells precipitated at the bottom of the well. Controls include RBC with no HA, which forms a button, and HA and RBC with no serum, which remains cloudy. The HAI titer of a particular serum sample is the reciprocal of the last dilution which prevents agglutination (i.e., forms a button). For example, if about a 1:128 dilution reads as a button but the 1:256 dilution does not, the HAI titer is about 128.

In one embodiment, the invention is a method of making a protein that stimulates a protective immune response in a subject, comprising the steps of separating a portion of a protein from a naturally occurring viral hemagglutinin to thereby make a protein portion, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain. The nucleic acid sequence encoding the protein portion is transformed into a prokaryotic cell and the prokaryotic host cell is cultured to thereby make the protein that stimulates a protective immune response in a subject.

"A portion of a protein," or "protein portion," as used herein in reference to a naturally occurring viral hemagglutinin, refers to any part of the naturally occurring viral hemagglutinin that is less than the entire naturally occurring viral hemagglutinin. "Naturally occurring viral hemagglutinin," as used herein, refers to the entire viral hemagglutinin, as it occurs in nature.

The protein portion can further lack a signal sequence. The protein portion can further include a sialic acid binding site.

Portions of a protein of a naturally occurring viral hemagglutinin for use in the compositions and methods of the invention can be a portion of Orthomyxoviridae (influenza A, B, C), Paramyxovirus (parainfluenza, respiratory syncytial virus. Newcastle disease virus, Nipah, Measles, canine distemper, Sendai virus), Reoviridae (rotavirus), Parvoviridae (human parvovirus, porcine parvovirus), Orthopoxvirus (Monkeypox virus, Ectromelia virus), Flaviviridae (West Nile, Japanese Encephalitis, St. Louis, Murray Valley, Kunjin), Avipoxvirus (Chicken fowlpox), Nipah virus (Guillaume V., et al., *J. Virol.,* 80:7546-54 (2006)); Canine distemper virus (Singethan K., et al., *J Gen Virol.,* 87:1635-42 (2006)); Newcastle disease virus, (de Leeuw O. S., et al. *J Gen Virol.,* 86:1759-69 (2005); and Melanson V. R., et al., *J. Virol.,* 78:13053-61 (2004); Deng R., et al., *Virology,* 204:17-26; (1994)), Measles (Masse N., et al., *J Virol.,* 78:9051-63 (2004)), Sendai virus (Tomasi M., et al., *FEBS Lett.,* 11:56-60 (2003)), Human parainfluenza (Porotto M., et al., *J Virol.,* 79:2383-92 (2005); Tsurudome M., et al., *Virology,* 213: 190-203 (1995); Bousse T., et al., *Virology,* 209:654-7 (1995); and Takimoto T., et al., *J Virol.,* 66:7597-600 (1992)).

Portions of a viral hemagglutinin ("protein portions") (e.g., an influenza A, an influenza B and an influenza C viral hemagglutinin) can include at least one member selected from the group consisting of protein portions referred to herein as "HA1-1," "HA1-2" and "HA1-3."

"HA1-1," as used herein, refers to a protein portion of a viral hemagglutinin that includes at least about one β-sandwich that includes the substrate binding site, which includes at least about two β-sheets, at least about two to about three short α-helixes, at least one small β-sheet and at least one additional small β-sandwich at the bottom of the molecule and at least about four disulfide bonds. The β-sandwich that includes the substrate binding site of the HA1-1 includes at least about four β-strands as the top sheet and at least about three to about four β-strands as the bottom sheet. At least about one α-helix of the HA1-1 portion is located by the side of β-sandwich that includes the substrate binding site and at least about one to about two are located at the bottom of the β-sandwich that includes the substrate binding site. The small β-sandwich of the HA1-1 can include at least about two to about three β-strands in each β-sheet; or about three to about four β-strands. Exemplary HA1-1 protein portions include SEQ ID NOS: 8, 11, 14, 17, 20, 38, 40, 45, 47, 49, 179, 180, 181 and 182.

"HA1-2," as used herein, refers to a protein portion of a viral hemagglutinin that includes at least about one β-sandwich that includes the substrate binding site, at least about two to about three short α-helixes, at least about one small β-sheet at the bottom of the molecule and at least about two disulfide bonds. A β-strand in a viral hemagglutinin can include between about two to about 15 amino acids. A small β-strand can include about two amino acids; or between about two to about three amino acids; or between about two to four amino acids or between about two to about five amino acids. A small β-sheet can include between about two to about three β-strands; or between about three to about four β-strands. The β-sandwich that includes the substrate binding site of HA1-2 can further include at least about four β-strands as the top sheet and at least about three to about four β-strands as the bottom sheet. At least about one α-helix of the HA1-2 portion is located by the side of the β-sandwich that includes the substrate binding site and at least about one to about two are located at the bottom of the β-sandwich that includes the substrate binding site. Exemplary HA1-2 protein portions include SEQ ID NOS: 9, 12, 15, 18, 21, 24, 26, 28, 30, 32, 39, 41, 46, 48 and 50.

"HA1-3," as used herein, refers to a protein portion of a viral hemagglutinin that includes at least one β-sandwich that includes the substrate binding site, at least about two short α-helixes and at least one disulfide bond. "β-sandwich," as used herein, refers to at least about two sets of beta-sheets that form at least about one interactive layer. "Substrate binding site," as used herein in reference to the β-sandwich, means any part of the portion of the naturally occurring viral hemagglutinin that has the capacity to interact or bind to a molecule. For example, the β-sandwich that includes the substrate binding site of the portion can include a portion that binds sialic acid. The β-sandwich that includes the substrate binding site of HA1-3 can further include at least about four β-strands as the top sheet and at least about three β strands as the bottom sheet. At least about one α-helix of the HA1-1 portion is located by the side of the β-sandwich that includes the substrate binding site and at least one other α-helix is located at the bottom of the β-sandwich that includes the substrate binding site. A short α-helix can include less than about 5 turns (2, 3, 4, 5 turns) in an α-helix. An α-helix in a viral hemagglutinin can be between one to about 15 turns; or between about two to 15 turns. Exemplary HA1-3 protein portions include SEQ ID NOS: 10, 13, 16, 19, 22, 25. 27, 29, 31 and 33.

"A sialic acid binding site," as that phrase is used herein in reference to the portion of the protein from the naturally occurring viral hemagglutinin, means a part of the protein portion that has the capacity to interact with sialic acid residues. "A sialic acid binding site" is also referred to herein as "a sialic acid binding domain."

"At least a portion," as used herein, refers to any part of a component (e.g., a globular head, a secondary structure) or molecule (e.g., a protein, antigen, Toll-like Receptor, a peptide, flagellin, HA, matrix 2 protein (M2), matrix 2 ectodomain (M2e)); or the entirety of the component or the molecule. "At least a portion," is also referred to herein as a "fragment."

"At least a portion," as used herein in reference to a flagellin (e.g., fljB/STF2, *E. coli* fliC, *S. muenchen* fliC), refers to any part of the flagellin (e.g., motif C; motif N; domain 1, 2, 3) or the entirety of the flagellin that can initiate an intracellular signal transduction pathway for a Toll-like Receptor.

A single polypeptide can exhibit several types of secondary structure. Without any stabilizing interactions, a polypeptide can assume a random-coil conformation. However, secondary structures, such as alpha (α)-helices and beta (β)-strands, can stabilize a protein or a portion of a protein. Lateral association of β-strands form β-sheets (also referred to herein as "β-pleated sheets"). Secondary structures can be located at the surfaces of the portion, the protein, or the naturally occurring protein (e.g., viral hemagglutinin, flagellin, M2e). A tertiary structure of a protein is the three-dimensional arrangement of amino acid residues. In contrast to secondary structure, which is stabilized by, for example, hydrogen bonds, α-helices, β-strands, tertiary structure results from hydrophobic interactions between non-polar side chains of the portion, protein or naturally occurring viral hemagglutinin. The hydrophobic interactions hold the helices strands in random coils in a compact internal scaffold. The size and shape of a protein can depend on its primary amino acid sequence, as well as the number, size and arrangement of secondary structures.

"A globular head," as that phrase is used herein, refers to a portion of a protein of a naturally occurring viral hemagglutinin that includes the receptor or sialic acid binding regions. "Globular head," is also referred to herein as a "globular domain." The globular head of viral hemagglutinin proteins has been determined based on x-ray crystallography as described, for example, by Wilson I. A., et al. *Nature* 289: 366-373 (1981); Chen, J., et al., *Cell* 95:409-417 (1998); Ha Y., et al., *The EMBO Journal* 21:865-875 (2002); Russell, R. J., et al., *Virology* 325:287-296 (2004); and Cox, N. J., et al., In: Toply and Wilson's Microbiology and Microbial Infections, eds. B W J Mathy, et al., Vol. 1 ($9^{th}$ ed.) New York, N.Y., Oxford Univ. Press, Ch. 32, p. 634 (1998). The globular head of a naturally occurring viral hemagglutinin is a component of the HA1 subunit of, for example, influenza viral hemagglutinin. In addition to the receptor binding domain, the globular head can include the $E^-$ subdomain and $F^-$ subdomain as described, for example, by Ha, Y., et al. *The EMBO Journal* 21:865-875 (2002).

The phrase, "causes the globular head to essentially retain its tertiary structure," as used herein, refers to maintenance of the tertiary structure of the globular head of the naturally occurring viral hemagglutinin sufficient to stimulate a protective immune response in a subject.

The membrane fusion domain of a viral hemagglutinin is that region of the viral hemagglutinin (involved in binding of the viral hemagglutinin) that binds a host cell. A transmembrane domain of the viral hemagglutinin is that portion of the viral hemagglutinin that spans the membrane of the virus. A cytoplasmic domain of a viral hemagglutinin is that portion of the viral hemagglutinin located on the cytoplasmic surface of the virus.

The portion of the protein of the naturally occurring viral hemagglutinin (also referred to herein as "protein portion") can further lack a signal sequence. The portion of a globular head employed in the methods described herein can include at least a portion of at least one secondary structure that includes at least a portion of at least one β-pleated sheet; at least one alpha helix and/or at least one member selected from the group consisting of a salt bridge, a leucine zipper and a zinc finger. The portion of a globular head can further include at least about one disulfide bond, at least about two disulfide bonds, at least about three disulfide bonds, at least about four disulfide bonds, at least about five disulfide bonds and at least about six disulfide bonds.

The method of making a protein that stimulates a protective immune response in a subject can further include the step of substituting a nucleic acid sequence encoding at least one amino acid residue selected from the group consisting of a hydrophilic amino acid residue, a polar amino acid residue and a neutral amino acid residue for a nucleic acid sequence that encodes at least one hydrophobic amino acid residue in the protein portion. The hydrophobic amino acid residue substituted can include at least one member selected from the group consisting of a phenylalanine residue, a tryptophan residue and tyrosine residue. The polar amino acid residue substituted for the hydrophobic amino acid can include at least one member selected from the group consisting of an aspartic acid residue and a glutamic acid residue.

The portion of a protein of a naturally occurring viral hemagglutinin can be a portion of a naturally occurring influenza viral hemagglutinin protein (e.g., influenza A, B and C). The influenza A viral hemagglutinin protein can be at least one member selected from the group consisting of H1, H2, H3, H5, H7 and H9.

The host cell employed in the methods described herein can be a prokaryotic host cell. The prokaryotic host cell can be at least one member selected from the group consisting of an *E. coli* prokaryotic host cell, a *Pseudomonas* prokaryotic host cell, a *Bacillus* prokaryotic host cell, a *Salmonella* prokaryotic host cell and a *P. fluorescens* prokaryotic host cell.

The method of making a protein that stimulates a protective immune response in a subject can further include the step of transforming the prokaryotic host cell with a chaperone nucleic acid sequence. The chaperone nucleic acid sequence can be at least one member selected from the group consisting of a groES-groEL chaperone, a dnaK-dnaJ-grpE chaperone, a groES-groEL-tig chaperone and a tig chaperone.

The method of making a protein that stimulates a protective immune response in a subject can further include the step of fusing at least a portion of a Toll-like Receptor (TLR) agonist to the protein. The nucleic acid sequence encoding at least a portion of a Toll-like Receptor agonist can be operably linked to the nucleic acid sequence encoding the protein portion of the viral hemagglutinin. A linker (e.g., peptide linker) can be between the Toll-like Receptor agonist and the portion of the viral hemagglutinin.

Toll-like Receptors refer to a family of receptor proteins that are homologous to the *Drosophila melangogaster* Toll protein. Toll-like Receptors are type I transmembrane signaling receptor proteins characterized by an extracellular leucine-rich repeat domain and an intracellular domain homologous to an interleukin 1 receptor. Toll-like Receptors include TLR1, TLR2, TLR3, TLR4, TLR5, TLR6, TLR7, TLR8, TLR9, TLR10, TLR11 and TLR12.

"Agonist," as used herein in referring to a TLR, means a molecule that activates a TLR signaling pathway. A TLR signaling pathway is an intracellular signal transduction pathway employed by a particular TLR that can be activated by a TLR ligand or a TLR agonist. Common intracellular pathways are employed by TLRs and include, for example, NF-κB, Jun N-terminal kinase and mitogen-activated protein kinase. The Toll-like Receptor agonist can include at least one member selected from the group consisting of a TLR1 agonist, a TLR2 agonist (e.g., Pam3Cys, Pam2Cys, bacterial lipoprotein), a TLR3 agonist (e.g., dsRNA), a TLR4 agonist (e.g., bacterial lipopolysaccharide), a TLR5 agonist (e.g., a flagellin), a TLR6 agonist, a TLR7 agonist, a TLR8 agonist, a TLR9 agonist (e.g., unmethylated DNA motifs), TLR10 agonist, a TLR11 agonist and a TLR12 agonist.

The Toll-like Receptor agonists for use in the methods and compositions of the invention can be a Toll-like Receptor agonist component that is at least a portion of a Toll-like Receptor agonist, wherein the Toll-like Receptor agonist component includes at least one cysteine residue in a position where a cysteine does not occur in the native Toll-like Receptor agonist, whereby the Toll-like Receptor agonist component activates a Toll-like Receptor.

TLR4 ligands (e.g., TLR4 agonists) for use in the compositions and methods of the invention can include at least one member selected from the group consisting of SEQ ID NOS: 359-406 (see, PCT/US 2006/002906/WO 2006/083706; PCT/US 2006/003285/WO 2006/083792; PCT/US 2006/041865; PCT/US 2006/042051).

| | |
|---|---|
| GGKSGRTG | (SEQ ID NO: 359) |
| KGYDWLVVG | (SEQ ID NO: 360) |
| EDMVYRIGVP | (SEQ ID NO: 361) |
| VKLSGS | (SEQ ID NO: 362) |
| GMLSLALF | (SEQ ID NO: 363) |
| CVVGSVR | (SEQ ID NO: 364) |
| IVRGCLGW | (SEQ ID NO: 365) |
| AAEERTLG | (SEQ ID NO: 366) |
| WARVVGWLR | (SEQ ID NO: 367) |
| SEGYRLFGG | (SEQ ID NO: 368) |
| LVGGVVRRGS | (SEQ ID NO: 369) |
| GRVNDLWLAA | (SEQ ID NO: 370) |
| SGWMLWREGS | (SEQ ID NO: 371) |
| ERMEDRGGDL | (SEQ ID NO: 372) |
| KLCCFTECM | (SEQ ID NO: 373) |
| AVGSMERGRG | (SEQ ID NO: 374) |
| RDWVGGDLV | (SEQ ID NO: 375) |
| FFEVAKISQQ | (SEQ ID NO: 376) |
| WWYWC | (SEQ ID NO: 377) |
| MHLCSHA | (SEQ ID NO: 378) |
| WLFRRIG | (SEQ ID NO: 379) |

-continued

| | |
|---|---|
| YWFWRIG | (SEQ ID NO: 380) |
| MHLYCIA | (SEQ ID NO: 381) |
| WPLFPWIV | (SEQ ID NO: 382) |
| DMRSHAR | (SEQ ID NO: 383) |
| MHLCTHA | (SEQ ID NO: 384) |
| NLFPFY | (SEQ ID NO: 385) |
| MHLCTRA | (SEQ ID NO: 386) |
| RHLWYHA | (SEQ ID NO: 387) |
| WPFSAYW | (SEQ ID NO: 388) |
| WYLRGS | (SEQ ID NO: 389) |
| GKGTDLG | (SEQ ID NO: 390) |
| IFVRMR | (SEQ ID NO: 391) |
| WLFRPVF | (SEQ ID NO: 392) |
| FLGWLMG | (SEQ ID NO: 393) |
| MHLWHHA | (SEQ ID NO: 394) |
| WWFPWKA | (SEQ ID NO: 395) |
| WYLPWLG | (SEQ ID NO: 396) |
| WPFPRTF | (SEQ ID NO: 397) |
| WPFPAYW | (SEQ ID NO: 398) |
| FLGLRWL | (SEQ ID NO: 399) |
| SRTDVGVLEV | (SEQ ID NO: 400) |
| REKVSRGDKG | (SEQ ID NO: 401) |
| DWDAVESEYM | (SEQ ID NO: 402) |
| VSSAQEVRVP | (SEQ ID NO: 403) |
| LTYGGLEALG | (SEQ ID NO: 404) |
| VEEYSSSGVS | (SEQ ID NO: 405) |
| VCEVSDSVMA | (SEQ ID NO: 406) |

TLR2 ligands (e.g., TLR2 agonists) for use in the compositions and methods of the invention can also include at least one member selected from the group consisting of SEQ ID NOS: 455-494 (see, PCT/US 2006/002906/WO 2006/083706; PCT/US 2006/003285/WO 2006/083792; PCT/US 2006/041865; PCT/US 2006/042051).

| | |
|---|---|
| NPPTT | (SEQ ID NO: 455) |
| MRRIL | (SEQ ID NO: 456) |
| MISS | (SEQ ID NO: 457) |
| RGGSK | (SEQ ID NO: 458) |
| RGGF | (SEQ ID NO: 459) |
| NRTVF | (SEQ ID NO: 460) |
| NRFGL | (SEQ ID NO: 461) |
| SRHGR | (SEQ ID NO: 462) |

-continued

| | |
|---|---|
| IMRHP | (SEQ ID NO: 463) |
| EVCAP | (SEQ ID NO: 464) |
| ACGVY | (SEQ ID NO: 465) |
| CGPKL | (SEQ ID NO: 466) |
| AGCFS | (SEQ ID NO: 467) |
| SGGLF | (SEQ ID NO: 468) |
| AVRLS | (SEQ ID NO: 469) |
| GGKLS | (SEQ ID NO: 470) |
| VSEGV | (SEQ ID NO: 471) |
| KCQSF | (SEQ ID NO: 472) |
| FCGLG | (SEQ ID NO: 473) |
| PESGV | (SEQ ID NO: 474) |
| DPDSG | (SEQ ID NO: 475) |
| IGRFR | (SEQ ID NO: 476) |
| MGTLP | (SEQ ID NO: 477) |
| ADTHQ | (SEQ ID NO: 478) |
| HLLPG | (SEQ ID NO: 479) |
| GPLLH | (SEQ ID NO: 480) |
| NYRRW | (SEQ ID NO: 481) |
| LRQGR | (SEQ ID NO: 482) |
| IMWFP | (SEQ ID NO: 483) |
| RVVAP | (SEQ ID NO: 484) |
| IHVVP | (SEQ ID NO: 485) |
| MFGVP | (SEQ ID NO: 486) |
| CVWLQ | (SEQ ID NO: 487) |
| IYKLA | (SEQ ID NO: 488) |
| KGWF | (SEQ ID NO: 489) |
| KYMPH | (SEQ ID NO: 490) |
| VGKND | (SEQ ID NO: 491) |
| THKPK | (SEQ ID NO: 492) |
| SHIAL | (SEQ ID NO: 493) |
| AWAGT | (SEQ ID NO: 494) |

The TLR2 ligand (e.g., TLR2 agonist) can also include at least a portion of at least one member selected from the group consisting of flagellin modification protein FlmB of *Caulobacter crescenius*; Bacterial Type III secretion system protein; invasin protein of *Salmonella*; Type 4 fimbrial biogenesis protein (PilX) of *Pseudomonas; Salmonella* SciJ protein; putative integral membrane protein of *Streptomyces*; membrane protein of *Pseudomonas*; adhesin of *Bordetella pertusis*; peptidase B of *Vibrio cholerae*; virulence sensor protein of *Bordetella*; putative integral membrane protein of *Neisseria meningitidis*; fusion of flagellar biosynthesis proteins FliR and FlhB of *Clostridium*; outer membrane protein (porin) of *Acinetobacter*; flagellar biosynthesis protein FlhF of *Helicobacter*; ompA related protein of *Xanthomonas*; omp2a porin of *Brucella*; putative porin/fimbrial assembly protein (LHrE) of *Salmonella*; wbdk of *Salmonella*; Glycosyltransferase involved in LPS biosynthesis; *Salmonella* putative permease.

The TLR2 ligand (e.g., TLR agonist) can include at least a portion of at least one member selected from the group consisting of lipoprotein/lipopeptides (a variety of pathogens); peptidoglycan (Gram-positive bacteria); lipoteichoic acid (Gram-positive bacteria); lipoarabinomannan (mycobacteria); a phenol-soluble modulin (*Staphylococcus epidermis*); glycoinositolphospholipids (*Trypanosoma Cruzi*); glycolipids (*Treponema maltophilum*); porins (*Neisseria*); zymosan (fungi) and atypical LPS (*Leptospira interrogans* and *Porphyromonas gingivalis*).

The TLR2 ligand (e.g., TLR2 agonist) can also include at least one member selected from the group consisting of SEQ ID NOS: 495-497 (see, PCT/US 2006/002906/WO 2006/083706; PCT/US 2006/003285/WO 2006/083792; PCT/US 2006/041865; PCT/US 2006/042051).

| | |
|---|---|
| KGGVGPVRRSSRLRRTTQPG | (SEQ ID NO: 495) |
| GRRGLCRGCRTRGRIKQLQSAHK | (SEQ ID NO: 496) |
| RWGYHLRDRKYKGVRSHKGVPR | (SEQ ID NO: 497) |

The TLR2 agonist can include at least a portion of a bacterial lipoprotein (BLP).

Figure 74:
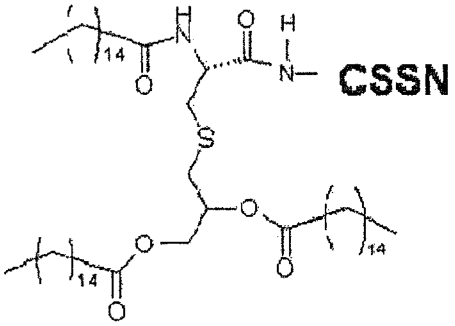
FIG. 74 depicts a tripalmitoylated peptide that includes CSSN (SEQ ID NO: 842.

The TLR2 agonist can be a bacterial lipoprotein, such as Pam2Cys (S—[2,3bis(palmitoyloxy) propyl]cysteine), Pam3 Cys ([Palmitoyl]-Cys((RS)-2,3-di(palmitoyloxy)-propyl cysteine) or *Pseudomonas aeruginosa* OprI lipoprotein (OprI). Exemplary OprI lipoproteins include SEQ ID NO: 782, encoded by SEQ ID NO: 783. An exemplary *E. coli* bacterial lipoprotein for use in the invention described herein is SEQ ID NO: 784 encoded by SEQ ID NO: 785. A bacterial lipoprotein that activates a TLR2 signaling pathway (a TLR2 agonist) is a bacterial protein that includes a palmitoleic acid (Omueti, K. O., et al., *J. Biol. Chem.* 280: 36616-36625 (2005)). For example, expression of SEQ ID NOS: 783 and 785 in bacterial expression systems (e.g., *E. coli*) results in the addition of a palmitoleic acid moiety to a cysteine residue of the resulting protein (e.g., SEQ ID NOS: 782 and 784) thereby generating a TLR2 agonist for use in the compositions, fusion proteins and polypeptides of the invention. Production of tripalmitoylated-lipoproteins (also referred to as triacyl-lipoproteins) in bacteria occurs through the addition of a diacylglycerol group to the sulfhydryl group of a cysteine (e.g., cysteine 21 of SEQ ID NO: 784) followed by cleavage of the signal sequence and addition of a third acyl chain to the free N-terminal group of the same cysteine (e.g., cysteine 21 of SEQ ID NO: 784) (Sankaran, K., et al., *J. Biol. Chem.* 269:19706 (1994)), to generate a tripalmitylated peptide (a TLR2 agonist) as shown, for example, in FIG. 74.

The Toll-like Receptor agonist in the compositions of the invention can further include at least one cysteine residue at the terminal amino acid of the amino-terminus and/or the terminal amino acid of the carboxy-terminus of the Toll-like Receptor agonist. For example, SEQ ID NO: 359 can further include at least one cysteine residue in a peptide bond to the amino-terminal glycine residue and/or at least one cysteine residue in a peptide bond to the carboxy-terminal glycine residue; SEQ ID NO: 360 can further include at least one cysteine residue in a peptide bond to the amino-terminal lysine residue and/or at least one cysteine residue in a peptide bond to the carboxy-terminal glycine residue; SEQ ID NO: 361 can further include at least one cysteine residue in a peptide bond to the amino-terminal glutamic acid residue and/or at least one cysteine residue in a peptide bond to the carboxy-terminal proline residue.

TLR5 agonists for use in the methods of the invention can include at least a portion of a flagellin. Flagellin are pathogen-associated molecular patterns (PAMPs) that activate TLR5.

The flagellin in the compositions and methods described herein can be at least a portion of a *S. typhimurium* flagellin (Genbank Accession Number AF045151); at least a portion of the *S. typhimurium* flagellin selected from the group consisting of SEQ ID NO: 498, SEQ ID NO: 812, SEQ ID NO: 816 and SEQ ID NO: 500; at least a portion of an *S. muenchen* flagellin (Genbank Accession Number AB028476) that includes at least a portion of SEQ ID NO: 504 and SEQ ID NO: 813; at least a portion of *P. aeruginosa* flagellin that includes at least a portion of SEQ ID NO: 815; at least a portion of a *Listeria monocytogenes* flagellin that includes at least a portion of SEQ ID NO: 820; at least a portion of an *E. coli* flagellin that includes at least a portion of SEQ ID NO: 502 and SEQ ID NO: 814; at least a portion of a *Yersinia* flagellin; and at least a portion of a *Campylobacter* flagellin.

The flagellin employed in the compositions of the invention can also include the polypeptides of SEQ ID NO: 498, SEQ ID NO: 500, SEQ ID NO: 504 and SEQ ID NO: 502; at least a portion of SEQ ID NO:498, at least a portion of SEQ ID NO: 500, at least a portion of SEQ ID NO: 504 and at least a portion of SEQ ID NO: 502; and a polypeptide encoded by SEQ ID NO: 499, SEQ ID NO: 501, SEQ ID NO: 505 and SEQ ID NO: 503; or at least a portion of a polypeptide encoded by SEQ ID NO: 499, SEQ ID NO: 501, SEQ ID NO: 505 and SEQ ID NO: 503.

The flagellin employed in the compositions and method of the invention can lack at least a portion of a hinge region. Hinge regions are the hypervariable regions of a flagellin. Hinge regions of a flagellin are also referred to herein as "D3 domain or region," "propellor domain or region," "hypervariable domain or region" and "variable domain or region." "Lack" of a hinge region of a flagellin, means that at least one amino acid or at least one nucleic acid codon encoding at least one amino acid that comprises the hinge region of a flagellin is absent in the flagellin. Examples of hinge regions include amino acids 176-415 of SEQ ID NO: 498, which are encoded by nucleic acids 528-1245 of SEQ ID NO: 499; amino acids 174-422 of SEQ ID NO: 502, which are encoded by nucleic acids 522-1266 of SEQ ID NO: 503; or amino acids 173-464 of SEQ ID NO: 504, which are encoded by nucleic acids 519-1392 of SEQ ID NO: 505. Thus, if amino acids 176-415 were absent from the flagellin of SEQ ID NO: 498, the flagellin would lack a hinge region. A flagellin lacking at least a portion of a hinge region is also referred to herein as a "truncated version" of a flagellin.

"At least a portion of a hinge region," as used herein, refers to any part of the hinge region of the flagellin, or the entirety of the hinge region. "At least a portion of a hinge region" is also referred to herein as a "fragment of a hinge region." At least a portion of the hinge region of fljB/STF2 can be, for example, amino acids 200-300 of SEQ ID NO: 498. Thus, if amino acids 200-300 were absent from SEQ ID NO: 498, the resulting amino acid sequence of STF2 would lack at least a portion of a hinge region.

Alternatively, at least a portion of a naturally occurring flagellin can be replaced with at least a portion of an artificial hinge region. "Naturally occurring," in reference to a flagellin amino acid sequence, means the amino acid sequence present in the native flagellin (e.g. *S. typhimurium* flagellin, *S. muenchin* flagellin, *E. coli* flagellin). The naturally occurring hinge region is the hinge region that is present in the native flagellin. For example, amino acids 176-415 of SEQ ID NO: 498, amino acids 174-422 of SEQ ID NO: 502 and amino acids 173-464 of SEQ ID NO: 504, are the amino acids corresponding to the natural hinge region of STF2, *E. coli* fliC and *S. muenchen* flagellins, fliC, respectively. "Artificial," as used herein in reference to a hinge region of a flagellin, means a hinge region that is inserted in the native flagellin in any region of the flagellin that contains or contained the native hinge region.

The hinge region of a flagellin be deleted and replaced with an antigen (e.g., HA1-1, HA 1-2, the maturational cleavage site) and the resulting construct fused to another antigen (e.g., 4×M2e).

An artificial hinge region may be employed in a flagellin that lacks at least a portion of a hinge region, which may facilitate interaction of the carboxy- and amino-terminus of the flagellin for binding to TLR5 and, thus, activation of the TLR5 innate signal transduction pathway. A flagellin lacking at least a portion of a hinge region is designated by the name of the flagellin followed by a "Δ." For example, an STF2 (e.g., SEQ ID NO: 498) that lacks at least a portion of a hinge region is referenced to as "STF2Δ" or "fljB/STF2Δ" (e.g., SEQ ID NO: 500).

The flagellin for use in the methods and compositions of the invention can be a at least a portion of a flagellin, wherein the flagellin component includes at least one cysteine residue and whereby the flagellin component activates a Toll-like Receptor 5; a flagellin component that is at least a portion of a flagellin, wherein at least one lysine of the flagellin component has been substituted with at least one arginine, whereby the flagellin component activates a Toll-like Receptor 5; a flagellin component that is at least a portion of a flagellin, wherein at least one lysine of the flagellin component has been substituted with at least one serine residue, whereby the flagellin component activates a Toll-like Receptor 5; a flagellin component that is at least a portion of a flagellin, wherein at least one lysine of the flagellin component has been substituted with at least one histidine residue, whereby the flagellin component activates a Toll-like Receptor 5, as described herein.

A recombinant fusion protein can be generated by operably linking a TLR agonist to the protein portion (e.g., HA1-1, HA1-2).

"Fusion protein," as used herein, refers to a protein generated from at least two similar or distinct components (e.g., a protein portion of HA and a TLR agonist). Fusion proteins can be generated recombinantly or by chemical conjugation.

In an embodiment, fusion proteins of protein portions of HA and TLR agonists (e.g., SEQ ID NOS: 89-92, 95, 151-160, 177, 209, 210 and 211) can be admixed or coadministered with fusion proteins of TLR agonists and M2e proteins (e.g., SEQ ID NOS: 528, 587, 589 and 591) and administered to a subject to stimulate an immune response, such as a protective immune response.

Fusion proteins of the invention can be designated by components of the fusion proteins separated by a ".". For example, "STF2.HA1-2" refers to a fusion protein comprising one STF2 protein and one HA1-2 protein; and "STF2Δ.HA1-2" refers to a fusion protein comprising one STF2 protein without the hinge region and HA1-2. Exemplary fusion proteins of the invention include SEQ ID NOS: 89-92, 95, 151-160, 177, 209, 210 and 211.

The fusion proteins can include, for example, two, three, four, five, six or more Toll-like Receptor agonists (e.g., flagellin) and two, three, four, five, six or more antigens (e.g., protein portions, such as HA1-1, HA1-2). When two or more TLR agonists and/or two or more protein portions comprise fusion proteins of the invention, they are also referred to as "multimers." For example, a multimer of HA1-1 can be four HA1-1 sequences, which is referred to herein as 4×HA1-1. Likewise. "2×HA1-1" is a multimer of two HA1-1 sequences. (See, for example, SEQ ID NOS: 342-346 and 348).

The fusion proteins of the invention can further include a linker between at least one component of the fusion protein (e.g., TLR agonist) and at least one other component of the fusion protein (e.g., HA1-1, HA1-2) of the composition, a linker between at least two of similar components of the fusion protein (e.g., HA1-1, HA1-2) or any combination thereof. "Linker," as used herein in reference to a fusion protein of the invention, refers to a connector between components of the fusion protein in a manner that the components of the fusion protein are not directly joined. For example, one part of the fusion protein (e.g., flagellin) can be linked to a distinct part (e.g., protein portion, HA1-1, HA1-2, an antigen) of the fusion protein. Likewise, at least two or more similar or like components of the fusion protein can be linked (e.g., two flagellin can further include a linker between each flagellin, or two HA proteins can further include a linker between each HA protein).

Additionally, or alternatively, the fusion proteins of the invention can include a combination of a linker between distinct components of the fusion protein and similar or like components of the fusion protein. For example, a fusion protein can comprise at least two TLR agonists that further includes a linker between, for example, two or more flagellin; at least two protein portions of HA that further include a linker between them; a linker between one component of the fusion protein (e.g., flagellin) and another distinct component of the fusion protein (e.g., protein portions of HA), or any combination thereof.

The linker can be an amino acid linker. The amino acid linker can include synthetic or naturally occurring amino acid residues. The amino acid linker employed in the fusion proteins of the invention can include at least one member selected from the group consisting of a lysine residue, a glutamic acid residue, a serine residue and an arginine residue. The amino acid linker can include, for example, SEQ ID NOS: 521, 523, 524 and 526, encoded by the nucleic acid sequences of SEQ ID NOS: 520, 522, 525 and 527 respectively.

The Toll-like Receptor agonist of the fusion proteins of the invention can be fused to a carboxy-terminus, the amino-terminus or both the carboxy- and amino-terminus of the protein portion of HA (e.g., HA1-1, HA1-2 or other antigens, such as the ectodomain of the Matrix 2 protein, a maturational cleavage site).

Figure 77:
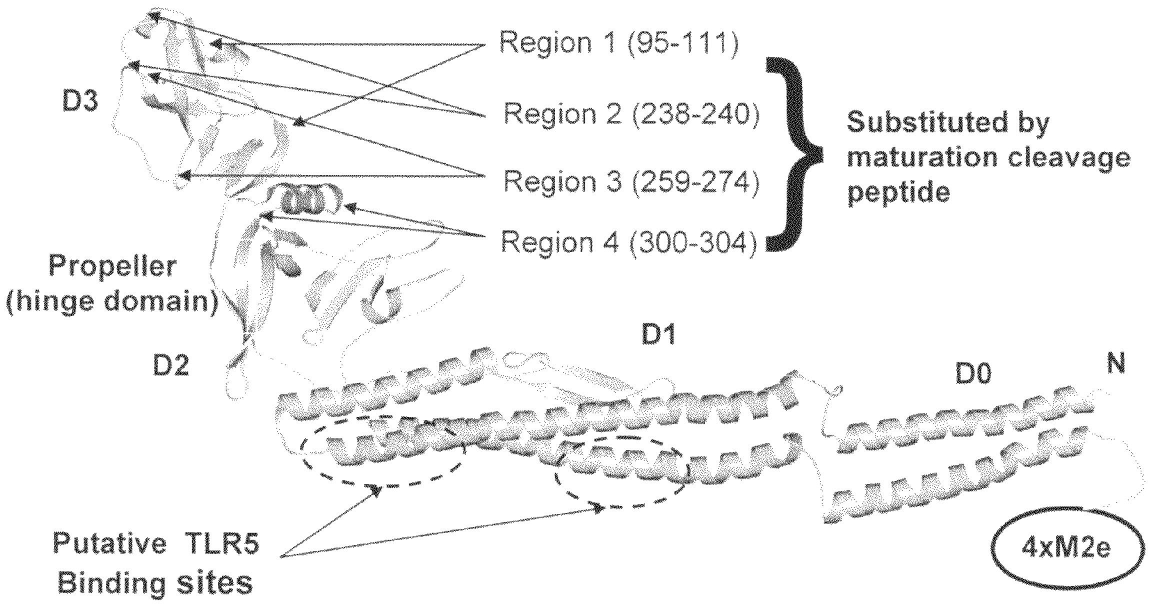
FIG. 77 depicts the D0, D1, D2 and D3 domains of flagellin and regions in the D2 and D3 domains suitable for insertion or substitution with antigens (e.g., maturational cleavage site, HA, M2e).

Fusion proteins can be generated by fusing the protein portions of HA (or other antigens, such as the maturational cleavage site of HA) to at least one of four regions (Regions 1, 2, 3 and 4) of flagellin, which have been identified based on the crystal structure of flagellin (PDB:1UCU) (see FIG. 77).

Region 1 is TIAL (SEQ ID NO: 823) . . . - . . . GLG (95-111 of SEQ ID NO: 841). The corresponding residues for *Salmonella typhimurium* fljB construct are TTLD (SEQ ID NO: 824) . . . - . . . GTN (196-216 of SEQ ID NO: 841). This region is an extended peptide sitting in a groove of two beta strands (GTDQKID (SEQ ID NO: 825) and NGEVTL (SEQ ID NO: 826) of (SEQ ID NO: 841). Substitution of this peptide with an antigen (e.g., HA maturational cleavage site) may mimic the conformation of wild type maturational cleavage site peptide in HA0. Exemplary amino acids that may be substituted include: flagellin residues SGLDDAAIKAAT (SEQ ID NO: 827) (201-212 of SEQ ID NO: 841) substituted with maturational cleavage site residues: RGIFGAIAGFIE (SEQ ID NO: 828), which correspond to the A/H3N2 subtype, or RGLFGAIAGFIE (SEQ ID NO: 803), which correspond to the maturational cleavage site residues from the A/H2N1, A/H1N1, A/H5N1 subtypes or with RGFFGAIAGFLE (SEQ ID NO: 805), which correspond to Influenza B HA maturational cleavage site residues.

Region 2 of the *Salmonella* flagellin is a small loop GTG (238-240 of SEQ ID NO: 841) in 1UCU structure (see FIG. 77). The corresponding loop in *Salmonella* fljB is GADAA (SEQ ID NO: 829) (244-248 of SEQ ID NO: 841). Insertion of an antigen (e.g., protein portions of HA, a maturation cleavage site peptide) in this loop or replacement of the entire loop with an antigen (e.g., protein portions of HA, a maturational cleavage site peptide) should preserve the extended loop structure of the maturational cleavage site peptide that is associated with the native HA molecule.

Region 3 is a bigger loop that resides on the opposite side of the Region 1 peptide (see FIG. 77). This loop can be simultaneously substituted together with region 1 to create a double copy of the antigen (e.g., protein portions of HA, a maturational cleavage site peptide). The loop starts from AGGA (SEQ ID NO: 830) and ends at PATA (SEQ ID NO: 831) (259-274 of SEQ ID NO: 841). The corresponding *Salmonella* fljB sequence is AAGA (SEQ ID NO: 832 . . . - . . . ATTK (SEQ ID NO: 833) (266-281 of SEQ ID NO: 841). The sequence AGATKTTMPAGA (SEQ ID NO: 834) (267-278 of SEQ ID NO: 841) can be replaced with the antigens (e.g., protein portions of HA, a maturation cleavage site peptides).

Region 4 is the loop (VTGTG (SEQ ID NO: 835)) connecting a short α-helix (TEAKAALTAA (SEQ ID NO: 836)) and a β-strand (ASVVKMSYTDN (SEQ ID NO: 837) in 1UCU structure (see FIG. 77). The corresponding loop in *Salmonella* fljB is a longer loop VDATDANGA (SEQ ID NO: 838 (307-315 of SEQ ID NO: 841). An antigen (e.g. a protein portion of HA, a maturation cleavage site peptide) can be inserted into or replace this region.

One or more copies of antigens (e.g., maturation cleavage site) can be inserted or used to replace the peptides listed in the above four regions. Preferably, the replacements would be in Region 1 and Region 3.

Exemplary sequences of maturation cleavage site peptides of HA are listed below:

| Sequence | Subtype |
|---|---|
| NVPEKQTRGIFGAIAGFIE | A/H3N2 (SEQ ID NO: 800) |
| NVPQIESRGLFGAIAGFIE | A/H2N1 (SEQ ID NO: 801) |
| NIPSIQSRGLFGAIAGFIE | A/H1N1 (SEQ ID NO: 802) |
| RERRRKKRGLFGAIAGFIE | A/H5N1 (SEQ ID NO: 839) |
| PAKLLKERGFFGAIAGFLE | B/HA (SEQ ID NO: 804) |

-continued

```
Sequence alignment of X-ray model (1UCU) and SEQ ID NO: 841
75.1% identity in 506 residues overlap; Score: 1703.0; Gap frequency: 2.6%

1UCU   1 AQVINTNSLSLLTQNNLNKSQSALGTAIERLSSGLRINSAKDDAAGQAIANRFTANIKGL  (SEQ ID NO: 840)
Sfla   2 AQVINTNSLSLLTQNNLNKSQSALGTAIERLSSGLRINSAKDDAAGQAIANRFTANIKGL  (SEQ ID NO: 841)
         ************************************************************

1UCU  61 TQASRNANDGISIAQTTEGALNEINNNLQRVRELAVQSANSTNSQSDLDSIQAEITQRLN
Sfla  62 TQASRNANDGISIAQTTEGALNEINNNLQRVRELAVQSANSTNSQSDLDSIQAEITQRLN
         ************************************************************

1UCU 121 EIDRVSGQTQFNGVKVLAQDNTLTIQVGANDGETIDIDLKQINSQTLGLDTLNVQQKYKV
Sfla 122 EIDRVSGQTQFNGVKVLAQDNTLTIQVGANDGETIDIDLKQINSQTLGLDSLNVQKAYDV
         ************************************************** ****  * *

1UCU 181 SDTAATVTGYAD--TTI---ALDNSTFKASATGLGGTDQKIDGDLKFDDTTGKYYAKVTV
Sfla 182 KDTAVTTKAYANNGTTLDVSGLDDAAIKAATGGTNGTASVTGGAVKFDADNNKYFVTIGG
          *** *   **   **     **    **   *  **     *  ***    **

1UCU 236 TGGT-GKDGYYEVSVDKTNGEVTLAGGATSPLTGGLPATATEDVKNVQVANADLTEAKA
Sfla 242 FTGADAAKNGDYEVNV-ATDGTVTLAAGATKTTMPAGATTKTEVQELKDTPAVVSADAKN
           *    * * *** *  * * **** ***         * **              **

1UCU 294 ALTAAGVTGT----ASVVKMSYTDNNGKTIDGGLAVKVGDDYYSATQNK-DGSISINTTK
Sfla 301 ALIAGGVDATDANGAELVKMSYTDKNGKTIEGGYALKAGDKYYAADYDEATGAIKAKTTS
         ** *  **  *    *  ******* ***** ** * * ** ** *      * *   **

1UCU 349 YTADDGTSKTALNKLGGADGKTEVVSIGGKTYAASKAEGHNFKAQPDLAEAAATTTENPL
Sfla 361 YTAADGTTKTAANQLGGVDGKTEVVTIDGKTYNASKAAGHDFKAQPELAEAAAKTTENPL
         *** *** *** * *** ******* * **** **** ** ***** ****** ******

1UCU 409 QKIDAALAQVDTLRSDLGAVQNRFNSAITNLGNTVNNLTSVRSRIEDSDYATEVSNMSRA
Sfla 421 QKIDAALAQVDALRSDLGAVQNRFNSAITNLGNTVNNLSEARSRIEDSDYATEVSNMSRA
         *********** **************************   *******************

1UCU 469 QILQQAGTSVLAQANQVPQNVLSLLR
Sfla 481 QILQQAGTSVLAQANQVPQNVLSLLR
```

The methods of making a protein that stimulates a protective immune response in a subject can further include the step of operably linking a nucleic acid sequence encoding a carrier protein to the nucleic acid sequence encoding a portion of the viral hemagglutinin.

"Carrier," as used herein, refers to a molecule (e.g., protein, peptide) that can enhance stimulation of a protective immune response. Carriers can be physically attached (e.g., linked by recombinant technology, peptide synthesis, chemical conjugation or chemical reaction) to a composition (e.g., a protein portion of a naturally occurring viral hemagglutinin) or admixed with the composition.

Carriers for use in the methods and compositions described herein can include, for example, at least one member selected from the group consisting of Tetanus toxoid (TT), *Vibrio cholerae* toxoid, Diphtheria toxoid (DT), a cross-reactive mutant (CRM) of diphtheria toxoid, *E. coli* enterotoxin, *E. coli* B subunit of heat labile enterotoxin (LTB), Tobacco mosaic virus (TMV) coat protein, protein Rabies virus (RV) envelope protein (glycoprotein), thyroglobulin (Thy), heat shock protein HSP 60 Kda. Keyhole limpet hemocyamin (KLH), an early secreted antigen tuberculosis-6 (ESAT-6), exotoxin A, choleragenoid, hepatitis B core antigen, and the outer membrane protein complex of *N. meningiditis* (OMPC) (see for example, Schneerson, R., et al., *Prog Clin Biol Res* 47:77-94 (1980); Schneerson, R., et al., *J Exp Med* 152:361-76 (1980); Chu, C., et al., *Infect Immun* 40: 245-56 (1983); Anderson, P., *Infect Immun* 39:233-238 (1983); Anderson. P., et al., *J Clin Invest* 76:52-59 (1985); Fenwick, B. W., et al., 54:583-586 (1986); Que, J. U. et al. *Infect Immun* 56:2645-9 (1988); Que. J. U., et al. *Infect Immun* 56:2645-9 (1988); (Que, J. U., et al. *Infect Immun* 56:2645-9 (1988); Murray, K., et al., *Biol Chem* 380:277-283 (1999); Fingerut, E., et al., *Vet Immunol Immunopathol* 112:253-263 (2006); and Granoff, D. M., et al., *Vaccine* 11:Suppl 1:S46-51 (1993)).

Exemplary carrier proteins for use in the methods and compositions described herein can include at least one member selected from the group consisting of SEQ ID NOS: 788-795:

```
Cross-reactive mutant (CRM) of diphtheria toxin
including, CRM197
                                        (SEQ ID NO: 788)
GADDVVDSSKSFVMENFSSYHGTKPGYVDSIQKGIQKPKSGTQGNYDDDW
KGFYSTDNKYDAAGYSVDNENPLSGKAGGVVKVTYPGLTKVLALKVDNAE
TIKKELGLSLTEPLMEQVGTEEFIKRFGDGASRVVLSLPFAEGSSSVEYI
NNWEQAKALSVELEINFETRGKRGQDAMYEYMAQACAGNRVRRSVGSSLS
CINLDWDVIRDKTKTKIESLKEHGPIKNKMSESPNKTVSEEKAKQYLEEF
HQTALEHPELSELKTVTGTNPVFAGANYAAWAVNVAQVIDSETADNLEKT
TAALSILPGIGSVMGIADGAVHHNTEEIVAQSIALSSLMVAQAIPLVGEL
VDIGFAAYNFVESIINLFQVVHNSYNRPAYSPGHKTQPFLHDGYAVSWNT
VEDSIIRTGFQGESGHDIKITAENTPLPIAGVLLPTIPGKLDVNKSKTHI
SVNGRKIRMRCRAIDGDVTFCRPKSPVYVGNGVHANLHVAFHRSSSEKIH
SNEISSDSIGVLGYQKTVDHTKVNSKLSLFFEIKS

Coat protein of Tobacco mosaic virus (TMV) coat
protein
                                        (SEQ ID NO: 789)
MMAYSIPTPSQLVYFTENYADYIPFVNRLINARSNSFQTQSGRDELREIL
IKSQVSVVSPISRFPAEPAYYIYLRDPSISTVYTALLQSTDTRNRVIEVE
NSTNVTTAEQLNAVRRTDDASTAIHNNLEQLLSLLTNGTGVFNRTSFESA
SGLTWLVTTTPRTA

Coat protein of alfalfa mosaic virus (AMV)
                                        (SEQ ID NO: 790)
MSSSQKKAGGKAGKPTKRSQNYAALRKAQLPKPPALKVPVAKPTNTILPQ
TGCVWQSLGTPLSLSSSNGLGARFLYSFLKDFAAPRILEEDLIFRMVFSI
TPSHAGSFCLTDDVTTEDGRAVAHGNPMQEFPHGAFHANEKFGFELVFTA
PTHAGMQNQNFKHSYAVALCLDFDALPEGSRNPSYRFNEVWVERKAFPRA
GPLRSLITVGLFDDADDLDRQ
```

-continued

Coat protein of Potato virus X (SEQ ID NO: 791)

```
MTTPANTTQATGSTTSTTTKTAGATPATTSGLFTIPDGEFFSTARAIVAS
NAVATNEDLSKIEAIWKDMKVPTDTMAQAAWDLVRHCADVGSSAQTEMID
TGPYSNGISRARLAAAIKEVCTLRQFCMKYAPVVWNWMLTNNSPPANWQA
QGFKPEHKFAAFDFFNGVTNPAAIMPKEGLIRPPSEAEMNAAQTAAFVKI
TKARAQSNDFASLDAAVTRGRITGTTTAEAVVTLPPP
```

Porins from *Neisseria* sp, e.g. class I outer membrane protein of *Neisseria meningitides*

(SEQ ID NO: 792)

```
MRKKLTALVLSALPLAAVADVSLYGEIKAGVEGRNYQLQLTEAQAANGGA
SGQVKVTKVTKAKSRIRTKISDFGSFIGFKGSEDLGEGLKAVWQLEQDVS
VAGGGATQWGNRESFIGLAGEFGTLRAGRVANQFDDASQAIDPWDSNNDV
ASQLGIFKRHDDMPVSVRYDSPEFSGFSGSVQFVPAQNSKSAYKPAYWTT
VNTGSATTTTFVPAVVGKPGSDVYYAGLNYKNGGFAGNYAFKYARHANVG
RDAFELFLLGSGSDQAKGTDPLKNHQVHRLTGGYEEGGLNLALAAQLDLS
ENGDKTKNSTTEIAATASYRFGNAVPRISYAHGFDFIERGKKGENTSYDQ
IIAGVDYDFSKRTSAIVSGAWLKRNTGIGNYTQINAASVGLRHKF
```

Major fimbrial subunit protein type I (Fimbrillin)

(SEQ ID NO: 793)

```
MVLKTSNSNRAFGVGDDESKVAKLTVMVYNGEQQEAIKSAENATKVEDIK
CSAGQRTLVVMANTGAMELVGKTLAEVKALTTELTAENQEAAGLIMTAEP
KTIVLKAGKNYIGYSGTGEGNHIENDPLKIKRVHARMAFTEIKVQMSAAY
DNIYTFVPEKIYGLIAKKQSNLFGATLVNADANYLTGSLTTFNGAYTPAN
YANVPWLSRNYVAPAADAPQGFYVLENDYSANGGTIHPTILCVYGKLQKN
GADLAGADLAAAQAANWVDAEGKTYYPVLVNFNSNNYTYDSNYTPKNKIE
RNHKYDIKLTITGPGTNNPENPITESAHLNVQCTVAEWVLVGQNATW
```

*Mycoplasma fermentans* macrophage activating lipopeptide (MALP-2)

(SEQ ID NO: 794)

```
MKKSKKILLGLSPIAAVLPAVAVSCGNNDESNISFKEKDISKYTTTNANG
KQVVKNAELLKLKPVLITDEGKIDDKSFNQSAFEALKAINKQTGIEINSV
EPSSNFESAYNSALSAGHKIWVLNGFKHQQSIKQYIDAHREELERNQIKI
IGIDFDIETEYKWFYSLQFNIKESAFTTGYAIASWLSEQDESKRVVASFG
VGAFPGVTTFNEGFAKGILYYNQKHKSSKIYHTSPVKLDSGFTAGEKMNT
VINNVLSSTPADVKYNPHVILSVAGPATFETVRLANKGQYVIGVDSDQGM
IQDKDRILTSVLKHIKQAVYETLLDLILEKEEGYKPYVVKDKKADKKWSH
FGTQKEKWIGVAENHFSNTEEQAKINNKIKEAIKMFKELPEDFVKYINSD
KALKDGNKIDNVSERLEAIISAINKAAK
```

p19 protein of Mycobacterium tuberculosis (SEQ ID NO: 795)

```
ATTLPVQRHPRSLFPEFSELFAAFPSFAGLRPTFDTRLMRLEDEMKEGRY
EVRAELPGVDPDKDVDIMVRDGQLTIKAERTEQKDFDGRSEFAYGSFVRT
VSLPVGADEDDIKATYDKGILTVSVAVSEGKPTEKHIQIRSTN
```

The compositions of the invention can further include at least one adjuvant. Adjuvants contain agents that can enhance the immune response against substances that are poorly immunogenic on their own (see, for example, Immunology Methods Manual, vol. 2, I. Lefkovits, ed., Academic Press, San Diego, Calif., 1997, ch. 13). Immunology Methods Manual is available as a four volume set, (Product Code Z37,435-0); on CD-ROM, (Product Code Z37,436-9); or both, (Product Code Z37,437-7). Adjuvants can be, for example, mixtures of natural or synthetic compounds that, when administered with compositions of the invention, such as proteins that stimulate a protective immune response made by the methods described herein, further enhance the immune response to the protein. Compositions that further include adjuvants may further increase the protective immune response stimulated by compositions of the invention by, for example, stimulating a cellular and/or a humoral response (i.e., protection from disease versus antibody production). Adjuvants can act by enhancing protein uptake and localization, extend or prolong protein release, macrophage activation, and T and B cell stimulation. Adjuvants for use in the methods and compositions described herein can be mineral salts, oil emulsions, mycobacterial products, saponins, synthetic products and cytokines. Adjuvants can be physically attached (e.g., linked by recombinant technology, by peptide synthesis or chemical reaction) to a composition described herein or admixed with the compositions described herein.

In another embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is not a *Pichia pastoris* eukaryotic host cell; and culturing the eukaryotic host cell to thereby make the protein. In one embodiment, the protein portion can further lack a signal sequence. In another embodiment, the protein portion can further include a sialic acid binding site.

In a further embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is not an insect eukaryotic host cell; and culturing the eukaryotic host cell to thereby make the protein that stimulates a protective immune response in a subject.

In a further embodiment, the invention is a method of making a protein that stimulates a protective immune response in a subject, comprising the steps of separating a portion of a protein from a naturally occurring viral hemagglutinin to thereby form a protein portion, wherein the protein portion includes at least a portion of a globular head, and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the protein portion into a eukaryotic host cell, wherein the eukaryotic host cell is not a stably transformed insect cell; and culturing the eukaryotic host cell to thereby make the protein that stimulates a protective immune response in a subject.

In another embodiment, the invention is a method of making a protein that stimulates a protective immune response in a subject, comprising the steps of separating a portion of a protein from a naturally occurring viral hemagglutinin to thereby make a protein portion, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain; infecting a nucleic acid sequence encoding the protein portion into an insect cell host cell (e.g., a baculovirus insect host cell, such as Sf9 or High5 cells); and culturing the insect host cell to thereby make the protein that stimulates a protective immune response in a subject.

The methods of making a protein that stimulates a protective immune response in a subject can further include the step of deleting at least one glycosylation site in the nucleic acid sequence encoding the protein portion. The glycosylation site that is deleted can include an N-glycosylation site.

The eukaryotic host cells employed in the methods of the invention can include a *Saccharomyces* eukaryotic host cell, an insect eukaryotic host cell (e.g., at least one member selected from the group consisting of a *Baculovirus* infected insect cell, such as *Spodoptera frugiperda* (Sf9) or *Trichhoplusia ni* (High5) cells; and a *Drosophila* insect cell, such as Dme12 cells), a fungal eukaryotic host cell, a parasite eukaryotic host cell (e.g., a *Leishmania tarentolae* eukaryotic host cell), CHO cells, yeast cells (e.g., *Pichia*) and a *Kluyveromyces lactis* host cell.

Suitable eukaryotic host cells and vectors can also include plant cells (e.g., tomato; chloroplast; mono- and dicotyledonous plant cells; *Arabidopsis thaliana; Hordeum vulgare, Zea mays*, potato, such as *Solanum tuberosum*; carrot, such as *Daucus carota* L.; and tobacco, such as *Nicotiana tabacum, Nicotiana benihamiana* (Gils, M., et al., *Plant Biotechnol J.* 3:613-20 (2005); He, D. M., et al., *Colloids Surf B Biointerfaces*, (2006); Huang, Z., et al., *Vaccine* 19:2163-71 (2001); Khandelwal, A., et al., *Virology.* 308:207-15 (2003); Marquet-Blouin, E., et al., *Plant Mol Biol* 51:459-69 (2003); Sudarshana, M. R., et al. *Plant Biotechnol J.* 4:551-9 (2006); Varsani, A., et al., *Virus Res,* 120:91-6 (2006); Kamarajugadda S., et al., *Expert Rev Vaccines* 5:839-49 (2006); Koya V, et al., *Infect Immun.* 73:8266-74 (2005); Zhang, X., et al., *Plant Biotechnol J.* 4:419-32 (2006)).

The proteins made by the methods of the invention and the compositions of the invention can be purified and characterized employing well-known methods (e.g., gel chromatography, cation exchange chromatography, SDS-PAGE), as described herein.

For large scale production, fermentation techniques can be employed, as described herein. Additional exemplary fermentation techniques can include a proposed cycle that can start with a culture inoculated into 6 L of MRBR media, as described herein, held at about 30° C. about pH 7, and DO controlled to greater than about 30%. A 6 liter feed can then be started at least about 30) minutes after glucose exhaustion. The proposed 6 liter feed media, when combined with 6 L of MRBR media, can provide the necessary conditions for *E. coli* growth based on about 52% utilization of carbon for growth. The feed may or may not include IPTG. The batch can be induced with at least 2 mM IPTG, introduced as a bolus, shortly after the feed is started to initiate production. The feed rate can start at about 20 mL feed per hour per liter bioreactor volume and increase over time based on the ability of the culture to accept more glucose without glucose accumulation. The culture can be harvested when the feed is complete. The 6 liter feed media, about pH 6.0, can include Glucose 180 g/L; $KH_2PO_4$ 2 g/L; $NaH_2PO_4(H_2O)$ 4 g/L; $(NH_4)_2HPO_4$ 12 g/L; $(NH_4)_2HSO_4$ 4 g/L; DL-Alanine 40 g/L; Citric Acid 4 g/L; $MgSO_4(7H_2O)$ 5.5 g/L; Trace Metals 6 mL; $CaCl_2$ 2.5 g/L; $FeSO_47H_2O$ 1 g/L.

Cell disruption and clarification in a large scale production can include removal of Triton X-100 from the resuspension buffer; dissolution of insolubles by the addition of 50 mM Tris, 25 mM NaCl, 8 M urea, about pH 8 to the lysate; addition of PEI (poly ethylamine) and subsequent removal by centrifugation with one or more of the buffers to remove nucleic acids and/or aid in filtration; the addition of flocullants, such as Aerosil 380, Aerosil 200, Alkoxide Alu C, and Celpur; and subsequent removal by centrifugation to aid in filtration. Cation exchange chromatography can include the use of a process resin, adding a denaturing endotoxin removal step containing up to 8 M urea and up to about 2% Triton X-100, and a step gradient elution. The step elution gradient can include about 100 to about 200 mM NaCl.

In yet another embodiment, the invention is a method of stimulating protective immunity in a subject, comprising the step of administering to the subject a composition that includes a protein made by a method comprising the steps of separating a portion of a protein from a naturally occurring viral hemagglutinin to thereby form a protein portion, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain; transforming a nucleic acid sequence encoding the portion into a prokaryotic host cell; and culturing the prokaryotic host cell to thereby make the protein that stimulates protective immunity in a subject.

In still another embodiment, the invention is a method of stimulating protective immunity in a subject, comprising the step of administering to the subject a composition that includes a protein portion of a naturally occurring viral hemagglutinin, wherein the protein portion includes at least a portion of a globular head and at least a portion of one secondary structure that causes the globular head to essentially retain its tertiary structure and wherein the protein portion lacks a membrane fusion domain, a transmembrane domain and a cytoplasmic domain.

In a further embodiment, the invention is a method of making a viral hemagglutinin protein that stimulates a protective immune response in a subject, comprising the steps of separating a portion of a protein from a naturally occurring viral hemagglutinin to thereby make a protein portion, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the portion in a eukaryotic host cell, wherein the eukaryotic host cell is not a *Pichia pastoris* eukaryotic host cell; and culturing the eukaryotic host cell to thereby make the protein that stimulates a protective immune response in a subject.

In yet another embodiment, the invention is a method of making a viral hemagglutinin protein that stimulates a protective immune response in a subject, comprising the steps of separating a portion of a protein from a naturally occurring viral hemagglutinin to thereby make a protein portion, wherein the protein portion includes at least a portion of a globular head and at least a portion of at least one secondary structure that causes the globular head to essentially retain its tertiary structure, and wherein the protein portion lacks a membrane fusion domain, a transmembrane domain and a cytoplasmic domain; transfecting a nucleic acid sequence encoding the portion in a eukaryotic host cell, wherein the eukaryotic host cell is not a *Drosophila melanogaster* eukaryotic host cell; and culturing the eukaryotic host cell to thereby make the protein that stimulates a protective immune response in a subject.

In still another embodiment, the invention is a method of making a viral hemagglutinin protein that stimulates a protective immune response in a subject, comprising the steps of transforming a prokaryotic host cell with a nucleic acid sequence encoding at least one viral hemagglutinin that lacks a transmembrane domain and a cytoplasmic domain; and culturing the prokaryotic cell to thereby make the protein that stimulates a protective immune response in a subject.

An additional embodiment of the invention is a method of stimulating protective immunity in a subject, comprising the step of administering to the subject a composition that includes a protein made by a method comprising the steps of transforming a prokaryotic host cell with a nucleic acid sequence encoding at least one viral hemagglutinin that lacks a transmembrane domain and a cytoplasmic domain; and culturing the prokaryotic host cell to thereby make the protein that stimulates a protective immune response in a subject.

In another embodiment, the invention is a method of stimulating protective immunity in a subject, comprising the step of administering to the subject a composition that includes a protein having at least one viral hemagglutinin that lacks a transmembrane domain and a cytoplasmic domain, wherein the protein was expressed in a prokaryotic cell.

In still another embodiment the invention is a composition comprising at least a portion of at least one pathogen-associated molecular pattern and a protein portion of a naturally occurring viral hemagglutinin, wherein the protein portion of the naturally occurring viral hemagglutinin includes at least a portion of a globular head and at least a portion of at least one secondary structure that causes the globular head to essentially retain its tertiary structure, and wherein the protein portion of the naturally occurring viral hemagglutinin lacks a membrane fusion domain, a transmembrane domain, and a cytoplasmic domain.

Pathogen-associated molecular patterns (PAMPs), such as a flagellin or a bacterial lipoprotein, refer to a class of molecules (e.g., protein, peptide, carbohydrate, lipid, lipopeptide, nucleic acid) found in microorganisms that, when bound to a pattern recognition receptor (PRR), can trigger an innate immune response. The PRR can be a Toll-like Receptor (TLR).

TLRs are the best characterized type of Pattern Recognition Receptor (PRR) expressed on antigen-presenting cells (APC). APC utilize TLRs to survey the microenvironment and detect signals of pathogenic infection by engaging the cognate ligands of TLRs, PAMPs. PAMP and TLR interaction triggers the innate immune response, the first line of defense against pathogenic insult, manifested as release of cytokines, chemokines and other inflammatory mediators; recruitment of phagocytic cells; and important cellular mechanisms which lead to the expression of costimulatory molecules and efficient processing and presentation of antigens to T-cells. TLRs control both innate and the adaptive immune responses.

Figure 40:
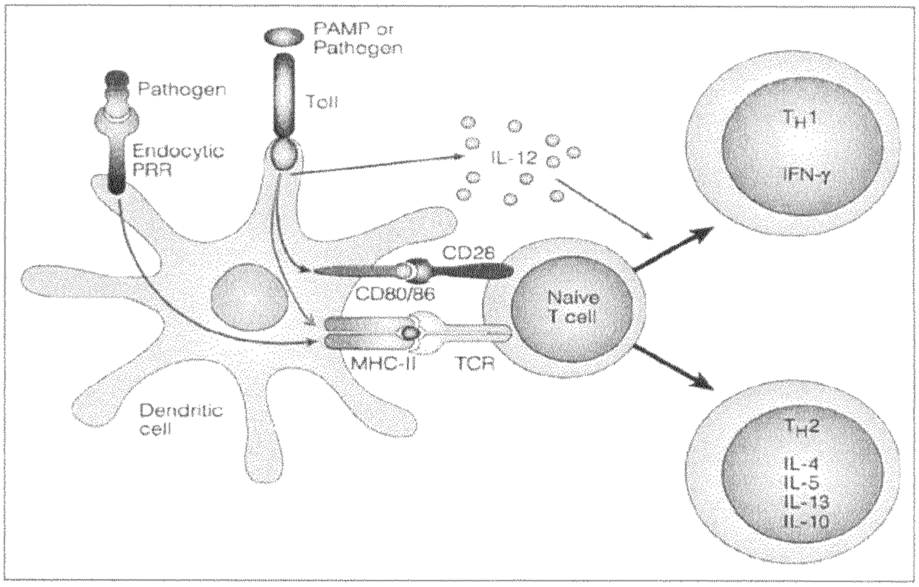
FIG. 40 depicts the activation of an antigen-presenting cell (APC) by Toll-like Receptor (TLR) signaling.
Figure 41A:
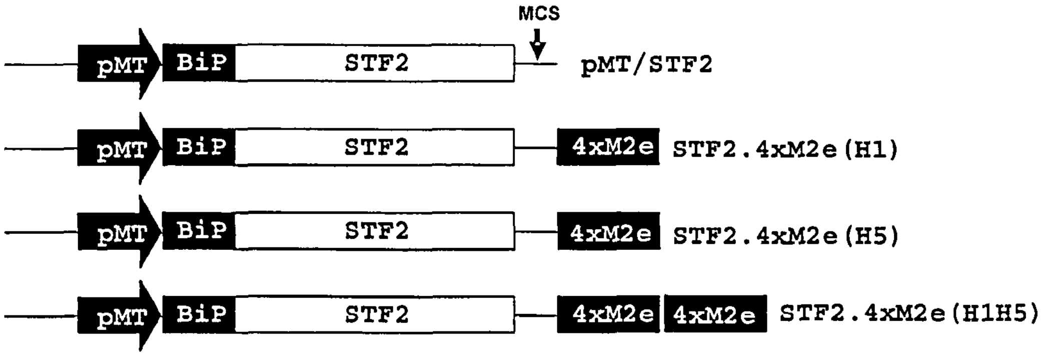
FIGS. 41A and 41B depict plasmid constructs to express an amino-terminus of an M2 (e.g., SEQ ID NOS: 510, 554) of H1 and H5 (SEQ ID NO: 536) influenza A viral isolates. pMT: metallothionein promoter-based expression vector. BiP: secretion signal sequence of immunoglobulin-binding protein. STF2: full-length flagellin of *S. typhimurium*. STF2Δ: hinge region-deleted STF2. MCS: multiple cloning site.
Figure 41B:
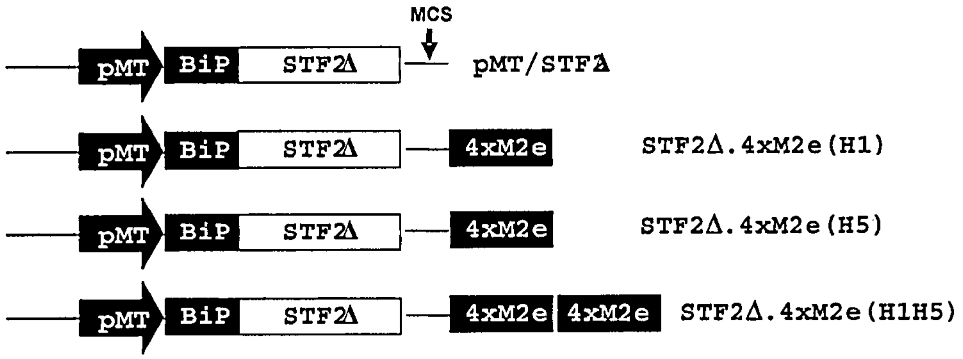

The binding of PAMPs to TLRs activates innate immune pathways. Target cells can result in the display of co-stimulatory molecules on the cell surface, as well as antigenic peptide in the context of major histocompatibility complex molecules (see FIG. 40). The compositions, fusion proteins or polypeptides of the invention can include a PAMP (e.g., a flagellin) that binds to a TLR (e.g., TLR5), promoting differentiation and maturation of the APC, including production and display of co-stimulatory signals (see FIG. 40). The compositions can be internalized by its interaction with the TLR and processed through the lysosomal pathway to generate antigenic peptides, which are displayed on the surface in the context of the major histocompatibility complex.

The compositions, fusion proteins and polypeptides of the invention employ pathogen-associated molecular patterns (TLR agonists) that trigger cellular events resulting in the expression of costimulatory molecules, secretion of critical cytokines and chemokines; and efficient processing and presentation of antigens to T-cells. As discussed above, TLRs recognize PAMPs including bacterial cell wall components (e.g., bacterial lipoproteins and lipopolysaccharides), bacterial DNA sequences that contain unmethylated CpG residues and bacterial flagellin. TLRs act as initiators of the innate immune response and gatekeepers of the adaptive immune response (Medzhitov, R., et al., *Cold Springs Harb. Symp. Quant. Biol.* 64:429 (1999); Pasare, C., et al., *Semin, Immunol* 16:23 (2004); Medzhitov, R., et al., *Nature* 388:394 (1997); Barton, G. M., et al., *Curr. Opin. Immunol* 14:380 (2002); Bendelac, A., et al., *J. Exp. Med.* 195:F19 (2002)).

As discussed above, the binding of PAMPs to TLRs activates immune pathways for use in the compositions, fusion proteins and polypeptides of the invention, which can be employed in stimulating the immune system in a subject. The compositions, fusion proteins and polypeptides of the invention can trigger an immune response to an antigen (e.g., a viral protein, such as an influenza viral) and trigger signal transduction pathways of the innate and adaptive immune system of the subject to thereby stimulate the immune system of a subject. Stimulation of the immune system of the subject may prevent infection by an antigen or a virus (e.g., an influenza virus) and thereby treat the subject or prevent the subject from disease, illness and, possibly, death.

In an additional embodiment, the invention is a composition comprising a flagellin component that is at least a portion of a flagellin, wherein the flagellin component includes at least one cysteine residue and whereby the flagellin component activates a Toll-like Receptor 5.

"Flagellin component," as used herein means at least part of or the entirety of a flagellin.

"Activates," when referring to a Toll-like Receptor (TLR), means that the component (e.g., a flagellin component or a Toll-like Receptor agonist component) stimulates a response associated with a TLR. For example, bacterial flagellin activates TLR5 and host inflammatory responses (Smith, K. D., et al., *Nature Immunology* 4:1247-1253 (2003)). Bacterial lipopeptide activates TLR1; Pam3Cys, Pam2Cys activate TLR2; dsRNA activates TLR3; LBS (LPS-binding protein) and LPS (lipopolysaccharide) activate TLR4; imidazoquinolines (anti-viral compounds and ssRNA) activate TLR7; and bacterial DNA (CpG DNA) activates TLR9. TLR1 and TLR6 require heterodimerization with TLR2 to recognize ligands (e.g., TLR agonists, TLR antagonists). TLR1/2 are activated by triacyl lipoprotein (or a lipopeptide, such as Pam3Cys), whereas TLR6/2 are activated by diacyl lipoproteins (e.g., Pam2Cys), although there may be some cross-recognition. In addition to the natural ligands, synthetic small molecules including the imidazoquinolines, with subclasses that are specific for TLR7 or TLR8 can activate both TLR7 and TLR8. There are also synthetic analogs of LPS that activate TLR4, such as monophosphoryl lipid A [MPL].

TLR activation can result in signaling through MyD88 and NF-κB. There is some evidence that different TLRs induce different immune outcomes. For example, Hirschfeld, et al. *Infect Immun* 69:1477-1482 (2001)) and Re, et al. *J Biol Chem* 276:37692-37699 (2001) demonstrated that TLR2 and TLR4 activate different gene expression patterns in dendritic cells. Pulendran, et al *J Immunol* 167:5067-5076 (2001)) demonstrated that these divergent gene expression patterns were recapitulated at the protein level in an antigen-specific response, when lipopolysaccharides that signal through TLR2 or TLR4 were used to guide the response (TLR4 favored a Th1-like response with abundant IFNγ secretion, while TLR2 favored a Th2-line response with abundant IL-5, IL-10, and IL-13 with lower IFNγ levels). There is redundancy in the outcome of signaling through different TLRs.

Activation of TLRs can result in increased effector cell activity that can be detected, for example, by measuring IFNγ-secreting CD8+ cells (e.g., cytotoxic T-cell activity);

increased antibody responses that can be detected by, for example, ELISA, virus neutralization, and flow cytometry (Schnare, M., et al., *Nat Immunol* 2:947 (2001); Alexopoulou, L., et al., *Nat Med* 8:878 (2002); Pasare, C., et al., *Science* 299:1033 (2003); Napolitani, G., et al., *Nat Immunol* 6:769 (2005); and Applequist, S. E., et al. *J Immunol* 175:3882 (2005)).

The composition comprising a flagellin component that is at least a portion of a flagellin, wherein the flagellin component includes at least one cysteine residue and whereby the flagellin component activates a Toll-like Receptor 5 can further include at least a portion of at least one member selected from the group consisting of a Toll-like Receptor 1 agonist, a Toll-like Receptor 2 agonist (e.g., Pam3Cys, Pam2Cys), a Toll-like Receptor 3 agonist, a Toll-like Receptor 4 agonist, a Toll-like Receptor 6 agonist, a Toll-like Receptor 7 agonist, a Toll-like Receptor 8 agonist a Toll-like Receptor 9 agonist, a Toll-like Receptor 10 agonist, a Toll-like Receptor 11 agonist and a Toll-like Receptor 12 agonist.

The a Toll-like Receptor 1 agonist, a Toll-like Receptor 2 agonist, a Toll-like Receptor 3 agonist, a Toll-like Receptor 4 agonist, a Toll-like Receptor 6 agonist, a Toll-like Receptor 7 agonist, a Toll-like Receptor 8 agonist a Toll-like Receptor 9 agonist a Toll-like Receptor 10 agonist, a Toll-like Receptor 11 agonist and a Toll-like Receptor 12 agonist employed in the compositions, such as compositions comprising a flagellin component that is at least a portion of a flagellin, wherein the flagellin component includes at least one cysteine residue and whereby the flagellin component activates TLR5, can further include at least one additional cysteine residue.

In one embodiment, at least one cysteine residue substitutes for at least one amino acid residue in a naturally occurring flagellin amino acid sequence of the flagellin component.

The cysteine residue that substitutes for at least one amino acid residue in a naturally occurring flagellin amino acid sequence of the flagellin component can be remote to at least one amino acid of the Toll-like Receptor 5 recognition site of the flagellin component. "Toll-like Receptor 5 recognition site," means that part of the TLR5 ligand (e.g., TLR5 agonist) that interacts with TLR5 to mediate a cellular response. "Toll-like Receptor 5 recognition site" is also referred to as a "Toll-like Receptor 5 activation site" and a "Toll-like Receptor 5 activation domain."

Likewise. "Toll-like Receptor recognition site," means that part of the Toll-like Receptor ligand (e.g., a Toll-like Receptor agonist) that interacts with its respective TLR to mediate a cellular response. "Toll-like Receptor recognition site" is also referred to as a "Toll-like Receptor activation site" and a "Toll-like Receptor activation domain."

The cysteine residue that substitutes for at least one amino acid residue in a naturally occurring flagellin amino acid sequence of the flagellin component can also be remote to at least one amino acid of the flagellin component involved in binding to the toll like receptor 5.

In another embodiment, the flagellin component includes at least a portion of a naturally occurring flagellin amino acid sequence in combination with the cysteine residue.

The cysteine residue used in combination (also referred to herein as "added cysteine") with at least a portion of a naturally occurring flagellin amino acid sequence can be at least one member selected from the group consisting of the amino-terminal amino acid of the flagellin component or the Toll-like Receptor agonist component and the carboxy-terminal amino acid of the flagellin component or the Toll-like Receptor agonist component. The cysteine residue used in combination with at least a portion of a naturally occurring flagellin amino acid sequence can be remote to at least one amino acid of the Toll-like Receptor 5 recognition site of the flagellin component or remote to at least one amino acid of the Toll-like Receptor recognition site of the Toll-like Receptor agonist component.

The cysteine residue used in combination with at least a portion of a naturally occurring flagellin amino acid sequence can be remote to at least one amino acid of the flagellin component involved in binding to the Toll-like Receptor 5 or remote to at least one amino acid of a Toll-like Receptor agonist component involved in binding to the Toll-like Receptor.

In another embodiment, the flagellin component lacks at least a portion of a hinge region of a naturally occurring flagellin amino acid sequence.

The composition comprising a flagellin component that is at least a portion of a flagellin, wherein the flagellin component includes at least one cysteine residue and whereby the flagellin component activates a Toll-like Receptor 5 can further include at least a portion of at least one antigen (e.g., an influenza antigen, such as an influenza A, B or C antigen).

The antigen can be an essentially hydrophobic antigen, such as a maturational cleavage site antigen of HA. The maturational cleavage site antigen can be at least one member selected from the group consisting of (SEQ ID NOS: 530, 532, 533, 534, 535, 600, 601, 602, 603 and NVPEKQTRGIFGAIAGFIE (H3) (SEQ ID NO: 796), NIPSIQSRGLFGAIAGFIE (H1) (SEQ ID NO: 797), PAKLLKERGFFGAIAGFLE (FLU B) (SEQ ID NO: 798), RERRRKKRGLFGAIAGFIE (H5) (SEQ ID NO: 799), RGLXGAIAGFIE (SEQ ID NO: 821) RGLXGAIAGFIE (SEQ ID NO: 822).

"Essentially hydrophobic," as used herein, means that the antigen has limited solubility in an aqueous solution or environment. The hydrophobic nature of peptides or proteins can be determined and compared, for example, by the Kyte-Doolitle hydrophobicity scale (Kyte, J., et al., *Mol. Biol.* 157: 105-132 (1982), (1982)), which assigns a numerical value for each of the 20 amino acids according to relative hydrophobicity. A positive value indicates a hydrophobic amino acid. A negative value indicates a hydrophilic amino acid. The average of these values for an individual peptide or polypeptide (calculated by adding the individual hydrophobicity values for each amino acid of the polypeptide or protein and dividing the total value by the number of amino acids in the polypeptide or protein) provides an index of overall hydrophobicity known as the "grand average of hydropathicity," also referred to as "GRAVY." A GRAVY value greater than zero indicates the protein or peptide is essentially hydrophobic. A GRAVY value less than zero indicates the protein or peptide is essentially hydrophilic. The individual hydrophobicity values, for the 20 naturally occurring amino acids according to the Kyte-Doolittle scale (Kyte, J., et al., *Mol. Biol.* 157: 105-132 (1982)), are as follows:

| | |
|---|---|
| Alanine | 1.8 |
| Arginine | −4.5 |
| Asparagine | −3.5 |
| Aspartic acid | −3.5 |
| Cysteine | 2.5 |
| Glutamine | −3.5 |
| Glutamic acid | −3.5 |
| Glycine | −0.4 |
| Histidine | −3.2 |
| Isoleucine | 4.5 |
| Leucine | 3.8 |
| Lysine | −3.9 |

-continued

| | |
|---|---|
| Methionine | 1.9 |
| Phenylalanine | 2.8 |
| Proline | −1.6 |
| Serine | −0.8 |
| Threonine | −0.7 |
| Tryptophan | −0.9 |
| Tyrosine | −1.3 |
| Valine | 4.2 |

The hydrophobicity of antigens, such as protein or peptide antigens, for use in the compositions and methods of the invention can be determined by calculating a GRAVY score based on the hydrophobicity values of the above Kyte-Doolittle scale. For example, GRAVY scores, which indicate essentially hydrophobic peptides, were calculated by addition of the hydrophobicity values (supra) of individual amino acids for the following maturational cleavage site amino peptides:

| Maturational Cleavage Site | GRAVY |
|---|---|
| NVPEKQ**TRGIFGAIAGFIE** (A/H3N2) (SEQ ID NO: 800) | 0.053 |
| NVPQIES**RGLFGAIAGFIE** (A/H2N1) (SEQ ID NO: 801) | 0.453 |
| NIPSIQS**RGLFGAIAGFIE** (A/H1N1) (SEQ ID NO: 802) | 0.611 |
| **RGLFGAIAGFIE** (Influenza A conserved region) (SEQ ID NO: 803) | 1.067 |
| PAKLLKE**RGFFGAIAGFLE** (Influenza B) (SEQ ID NO: 804) | 0.400 |
| **RGFFGAIAGFLE** (Influenza B conserved region) (SEQ ID NO: 805) | 0.925 |

Likewise, GRAVY scores, which indicate essentially hydrophilic peptides, were calculated for the following peptides:

| Amino Acid Sequence | GRAVY |
|---|---|
| human influenza M2e (SEQ ID NO: 806) SLLTEVETPIRNEWGSRSNDSSDP | −1.129 |
| Vietnam influenza M2e (SEQ ID NO: 807) GSGAG SLLTEVETPTRNEWECRCSDSSDP | −0.907 |
| Hong Kong influenza M2e (SEQ ID NO: 808) GSGAGSLLTEVETLTRNGWGCRCSDSSDP | −0.507 |
| West Nile Virus E peptide 001 (SEQ ID NO: 809) LTSGHLKCRVKMEKLQLKGT | −0.475 |
| Dengue 2 E peptide (SEQ ID NO: 810) EAEPPFGDSYIIIGVEPGQLKLNWFKK | −0.333 |
| BCRABL wt peptide (SEQ ID NO: 811) SLLTEVETPIRNEWGSRSNDSSDP | −1.129 |

An antigen can be any molecule (e.g., protein, peptide, glycoprotein, glycopeptide, carbohydrate, lipid, lipopeptide, polysaccharide) that can be recognized by the components of the immune system regardless of whether it can trigger activation of the immune system. The antigen can be a fragment or portion of a naturally occurring antigen or a synthetic molecule that mimics the naturally occurring antigen or a portion of the naturally occurring antigen.

The antigen can be a viral antigen. A "viral antigen," as used herein, refers to any portion of a virus (e.g., influenza virus, flavivirus) that generates an immune response in a subject either when employed in combination with a TLR agonist (e.g., a flagellin, Pam2Cys, Pam3Cys) or in the absence of a TLR agonist. The viral antigen can be a portion or a fragment of a naturally occurring virus or a synthetic molecule that mimics a naturally occurring virus, such as a recombinant or synthetic protein (e.g., influenza virus, flavivirus), peptide, lipid, carbohydrate, that generates an immune response in the subject. The influenza antigen can include at least one member selected from the group consisting of an influenza A antigen, influenza B antigen and an influenza C antigen. The influenza antigen can be an influenza virus integral membrane protein, such as HA, or a protein portion of HA, such as HA1-1 and HA1-2.

The antigen can be at least a portion of an influenza Matrix 2 (M2) protein, including at least a portion of the ectodomain of an influenza M2 protein (M2e).

Matrix protein 2 (M2 or M2 protein) is a proton-selective integral membrane ion channel protein of the influenza A virus. M2 is abundantly expressed at the plasma membrane of virus-infected cells, but is generally underexpressed by virions. For example, a portion of an M2 sequence of influenza A is SEQ ID NO: 508, which is encoded by SEQ ID NO: 509. The native form of the M2 protein is a homotetramer (i.e., four identical disulfide-linked M2 protein molecules). Each of the units are helices stabilized by two disulfide bonds. M2 is activated by low pH. Each of the M2 protein molecules in the homotetramer consists of three domains: a 24 amino acid outer or N (amino)-terminal domain (e.g., SEQ ID NO: 510; also referred to herein as a "human consensus sequence"), which is encoded by SEQ ID NO: 511; a 19 hydrophobic amino acid transmembrane region, and a 54 amino acid inner or C (carboxy)-terminal domain. The M2 protein can vary depending upon the influenza viral subtype (e.g., H1 and H5 subtypes of influenza A) and influenza viral, source (e.g., Puerto Rico, Thailand, New York, Hong Kong); as shown, for example, in exemplary amino-terminal sequences of M2 proteins (SEQ ID NOS: 544-556 and 570-578) and as described in PCT/US2005/046662 (WO2006/069262).

The M2 protein has an important role in the life cycle of the influenza A virus. It is important in the uncoating stage where it permits the entry of protons into the viral particle, which lowers the pH inside the virus, resulting in dissociation of the viral matrix protein M1 from the ribonucleoprotein RNP. As a consequence, the virus coat is removed and the contents of the virus are released from the endosome into the cytoplasm of the host cell for infection.

The function of the M2 channel can be inhibited by antiviral drugs, such as amantadine and rimantadine, which prevent the virus from infecting the host cell. Such antiviral drugs usually bind the transmembrane region of the M2 protein and sterically block the ion channel created by the M2 protein, which prevents protons from entering and uncoating the virion.

The M2 protein for use in the compositions and methods of the invention can that include at least a portion of SEQ ID NO: 510 encoded by SEQ ID NO: 511 or at least a portion of SEQ ID NO: 544, encoded by SEQ ID NO: 603. The M2 protein can further include at least one member selected from the group consisting of SEQ ID NO: 512, SEQ ID NO: 516, SEQ ID NO: 531; SEQ ID NO: 536 (Flu A H5N1 M2e, 2004 Viet Nam Isolate with serine replacing cysteine); SEQ ID NO: 537

(Flu A H5N1 M2e. 2004 Viet Nam Isolate); SEQ ID NO: 538 (Flu A H5N1 M2e, Hong Kong 97 Isolate with serine replacing cysteine); SEQ ID NO: 539 (Flu A H5N1 M2e, Hong Kong 97 Isolate); SEQ ID NO: 540 (Flu A H7N2 M2e Chicken/New York 95 Isolate with serine replacing cysteine); SEQ ID NO: 541 (Flu A H7N2 M2e, Chicken/New York 95 Isolate); SEQ ID NO: 542 (Flu A H9N2 M2e, Hong Kong 99 Isolate with serine replacing cysteine); and SEQ ID NO: 543 (Flu A, Hong Kong 99 Isolate). Certain cysteine residues, for example, amino acids 16 and 18 of SEQ ID NO: 537; amino acids 17 and 19 of SEQ ID NOS: 539, 541 and 543 in the naturally occurring sequence of at least a portion of M2 protein are replaced with a serine (see, SEQ ID NOS: 538, 540, 542 and 544, respectively).

The compositions comprising a flagellin component that is at least a portion of a flagellin, wherein the flagellin component includes at least one cysteine residue and whereby the flagellin component activates a Toll-like Receptor 5 that further includes an antigen (e.g., a maturational cleavage site peptide, protein portion of HA, such as HA1-1, HA1-2) can be co-administered or admixed with another flagellin component that is at least a portion of a flagellin, wherein the flagellin component includes at least one cysteine residue and whereby the flagellin component activates a Toll-like Receptor 5 that further includes a different, distinct antigen (e.g., M2e) or a fusion protein of a TLR agonist and an antigen (e.g., STF2.HA1-1, STF2.HA1-2, STF2Δ.HA1-1, STF2Δ.HA1-2, STF2.M2e, STF2.4×M2e, STF2Δ.M2e, STF2Δ.4×M2e).

The antigen included in the compositions and employed in the methods of the invention can be at least a portion of a microbial-related antigen, for example, antigens of pathogens, such as viruses, fungi or bacteria. Antigens can also be microorganism-related, and other disease-related antigens, such as antigens associated with allergies and cancer. The antigen can also be at least a portion of an antigen of a bacteria, a virus, a fungi, a yeast, a protozoa, a metazoa, a tumor, a malignant cell, a plant cell, an animal cell, a hormone and an amyloid-β peptide. The antigen can be a peptide, a polypeptide, a lipoprotein, a glycoprotein and a mucoprotein.

The antigen included in the compositions and employed in the methods of the invention can be a pathogen-related antigen. "Pathogen-related antigen," as used herein, refers to any molecule (e.g., protein, peptide, carbohydrate, lipoprotein, polysaccharide) that is associated with a pathogen. Exemplary pathogen-related antigens include, for example, antigens of vaccinia, avipox virus, turkey influenza virus, bovine leukemia virus, feline leukemia virus, avian influenza, chicken pneumovirosis virus, canine parvovirus, equine influenza, FHV, Newcastle Disease Virus (NDV), Chicken/Pennsylvania/1/83 influenza virus, infectious bronchitis virus; Dengue virus, measles virus, Rubella virus, pseudorabies, Epstein-Barr Virus, HIV, SIV, EHV, BHV, HCMV, Hantaan. *C. tetani*, mumps, Morbillivirus, Herpes Simplex Virus type 1, Herpes Simplex Virus type 2, Human cytomegalovirus, Hepatitis A Virus, Hepatitis B Virus, Hepatitis C Virus, Hepatitis E Virus, Respiratory Syncytial Virus, Human Papilloma Virus, Influenza Virus, *Salmonella, Neisseria, Borrelia, Chlamydia, Bordetella, Plasmodium* (e.g., *Plasmodium falciparum* and *Plasmodium vivax*), *Toxoplasma, Cryptococcus, Streptococcus, Staphylococcus, Haemophilus, Diptheria, Tetanus, Pertussis, Escherichia, Candida, Aspergillus, Entamoeba, Giardia* and *Trypanasoma.*

The antigen included in the compositions and employed in the methods of the invention can include bacterial capsular antigens. Exemplary bacterial capsular antigens include, for example, at least one member selected from the group consisting of a Group B *Streptococcus*, including *Streptococcus agalactiae*, capsular polysaccharides type Ia, Ib, Ia/c, II, III, IV, V and VI; *Streptococcus pneumoniae* capsular polysaccharides types 1, 2, 3, 4, 5, 6A, 6B, 7F, 9N, 9V, 10A, 11A, 12F, 14, 15B, 17F, 18C, 19A, 20, 22F, 23F, and 33F or any combination of these (typing according to the Danish system): *Staphylococcus aureus* capsular polysaccharides type 5, 8 and 336; *Bacillus anthracis* vegetative state capsular poly gamma D glutamic acid; *Mycobacteria* tuberculosis lipoarabino mannan capsule; *Plasmodium flaciparum* surface oligosaccharide; *Neisseria meningitidis* capsular polysaccharides of group A, B, C, X, Y and W135 or any combination thereof.

Compositions comprising the flagellin component that is at least a portion of a flagellin, wherein the flagellin component includes at least one cysteine residue and whereby the flagellin component activates a Toll-like Receptor 5 can include an antigen that is produced by chemical modification of the side-chains of the antigen (e.g., capsular antigens, pathogen-related antigens, influenza antigens, flavivirus antigens) in a manner that generates an active group that is coupled (also referred to herein as chemical conjugation) to a compatible reactive group created on the substituted flagellins of the invention (see infra). Derivatization (modification) of the capsular material is carried out so that a small minority of the side-chains are modified (about 5%) to avoid destruction of the majority of immunoreactive structures on the capsular material.

The antigen included in the compositions and employed in the methods of the invention can be at least a portion of at least one member selected from the group consisting of a West Nile viral protein, a Langat viral protein, a Kunjin viral protein, a Murray Valley encephalitis viral protein, a Japanese encephalitis viral protein, a Tick-borne encephalitis viral protein, Dengue 1 viral protein, Dengue 2 viral protein, Dengue 3 viral protein, Dengue 4 viral protein, hepatitis C viral protein and a Yellow fever viral protein (see, for example, PCT/US2006/001623 (WO2006/078657)).

The genus flavivirus is in the virus family *Flaviviridae* and consists of about 70 viruses. Mosquito or ticks transmit most of these viruses. Several flaviviruses are significant human pathogens, including the four dengue viruses (Den1, Den2. Den3 and Den4), yellow fever (YF), Japanese encephalitis (JE), West Nile (WN, also referred to herein as "WNV") and Tick-borne encephalitis (TBE) (Weaver S. C. et al., *Nat Rev Microbiol* 10: 789-801 (2004)). The flavivirus genus is divided into a number of serogroups based on cross-neutralization tests, including the dengue serogroup that contains four serologically and genetically distinct viruses termed DEN-1, DEN-2, DEN-3 and DEN-4.

Flaviviruses are small, enveloped viruses with icoshedral capsids. The flavivirus genome is a single-stranded positive-sense RNA (about 11 kb) that is directly translated by the host cell machinery following infection. The viral genome is translated as a single polypeptide that undergoes co- and post-translational cleavage by viral and cellular enzymes to generate three structural proteins of the flavivirus (the capsid (C), the membrane (M) and the envelope (E) proteins); and seven nonstructural proteins (NS1, NS2A, NS2B, NS3, NS4A, NS4B, and NS5) (Weaver, et al., *Annu Rev Microbiol* 1990:44-649 (2004)). The viral capsid is composed of the C-protein, while both the M- and envelope proteins are located on the envelope surface of the virion (Weaver, S. C., et al., *Nat. Rev. Microbiol.* 10:789-801 (2004); Chambers et al., *Annu Rev. Microbiol.* 44: 649-688 (1990)). A major immunogen for flaviviruses is the membrane envelope protein.

A flavivirus can enter a host cell when the viral envelope protein binds to a receptor and responds by conformational rearrangement to the reduced pH of an endosome. The conformational change induces fusion of viral and host-cell membranes.

The envelope of a flavivirus may function as a receptor binding protein and to facilitate fusion Of the virus and host cell membrane. Envelope proteins of flaviviruses have common structural (domains I, II and III) and functional features (receptor binding of virus and host cell and fusion functions) and are class II fusion glycoproteins (Lescar et al., *Cell* 105.137-148 (2001)).

In the pre-fusion conformation, envelope proteins form homodimers on the outer surface of the virus particles (Rey, et al., *Nature* 375:291-298); Kuhn, et al., *Cell* 108:717-725 (2002); Mukhopadhyay, et al., *Science* 302:248 (2003)). Each envelope protein monomer folds into three structural domains (domains I, II and III) predominantly composed of β-strands. Domain I (also referred to herein as "I" or "DI") is centrally located in the structure and has an N-glycosylation site in glycosylated envelope proteins. Domain II (also referred to herein as "II" or "DII") of the envelope protein promotes dimerization and has a fusion loop that inserts into the target host membrane during the pH-dependent fusion of the virus (Modis, et al., *Nature* 427:313-319 (2004); Bressanelli, et al., *EMBO J.* 23:728-738 (2004)). Domain III (also referred to herein as "III" or "DIII") is at the carboxy-terminus of the envelope protein. Domain III is also referred to as "domain B" in earlier antigenic mapping studies. Domain III has several epitopes that can elicit virus-neutralizing antibodies (Roehrig, *Adv Virus Res* 59:141-175 (2003)).

Domain I of the Tick-borne encephalitis envelope protein corresponds to amino acids 1-51, 137-189 and 285-302 of SEQ ID NO: 777; domain II of the Tick-borne encephalitis envelope protein of SEQ ID NO: 777 corresponds to amino acids 52-136 and 190-284; and domain III corresponds to amino acids 303-395 of SEQ ID NO: 777. (Rey, F. A., et al., *Nature* 375:291-298 (1995)). SEQ ID NO: 777 is encoded by SEQ ID NO: 778. Domain I of the Dengue 2 flavivirus envelope protein corresponds to amino acids 1-52, 132-193 and 280-296 of SEQ ID NO: 763; domain II corresponds to amino acids 53-131 and 194-279 of SEQ ID NO: 763; and domain III corresponds to amino acids 297-495 of SEQ ID NO: 763 (Modis, Y., et al., *Nature* 427:313-319 (2004)). The location of domains I, II and III of other flavivirus (e.g., West Nile virus, Japanese encephalitis, Dengue 1 virus, Dengue 3 virus and Dengue 4 virus) is based on homology of the Tick-borne encephalitis envelope protein domains and the Dengue 2 envelope protein domains. Thus, reference herein to domains of flavivirus proteins, in particular, flaviviruses other than Tick-borne encephalitis flavivirus envelope proteins and Dengue 2 flavivirus envelope proteins, are based on homology to domains in the Tick-borne encephalitis flavivirus envelope protein and the Dengue 2 flavivirus envelope protein.

The domain III of the envelope protein of the DEN flavivirus encodes the majority of the flavivirus type-specific contiguous critical/dominant neutralizing epitopes (Roehring, J. T., *Adv. Virus Res.* 59:141 (2003)), including the four DEN (DEN1, DEN2, DEN3, DEN4) viruses. Flavivirus envelope proteins are highly homologous. Exemplary envelope protein sequences are SEQ ID NOS: 642, 763, 765, 767, 769 and 774.

West Nile virus (WNV) is a single-stranded positive sense RNA envelope virus. It was first isolated and identified in the West Nile region of Uganda in 1937 from a febrile female adult (Smithburn, et al., *Am J Trop Med Hyg* 3.9-18 (1954)).

Japanese encephalitis (JE) virus is localized in Asia and northern Australia (about 50,000 cases with about 10,000 deaths annually).

The Dengue (DEN) disease is caused by four mosquito-borne, serologically related flaviviruses known as DEN-1 (also referred to herein as "Den1" or Den 1"), DEN-2 (also referred to herein as "Den2" or "Den 2"), DEN-3 (also referred to herein as "Den3" or "Den 3"), and DEN-4 (also referred to herein as "Den4" or Den 4"). The compositions, fusion proteins and polypeptides of the invention can include Den 1 SEQ ID NO.: 623; Den 1 PR 94 (Puerto Rico, 1994) SEQ ID NO: 624; Den 3 SEQ ID NO: 626; and Den 4 SEQ ID NO: 627. SEQ ID NOS: 623, 624, 625, 626 and 627 are portions of domain III of Den1, Den2, Den3 and Den4 flaviviruses.

"EI," "EII," and "EIII," as used herein, refer to domains I, II and III, respectively, of the West Nile flavivirus envelope protein. "JEI," "JEII," and "JEIII," as used herein, refer to domains I, II and III, respectively, of the Japanese encephalitis flavivirus envelope protein. "Den1 I," "Den1 II," and "Den1 III," as used herein refer to domains I, II and III, respectively, of the Dengue 1 flavivirus envelope protein. Likewise, designations for the domains of envelope proteins of other flaviviruses are referenced by the flavivirus name followed by the domain number (e.g., (Tick-borne) TBI (Tick-borne), TBII, TBIII, Den2 I, Den2 II, Den2 III).

The portion of an envelope protein of a flavivirus can include at least one member selected from the group consisting of at least a portion of domain I, at least a portion of domain II and at least a portion of domain III. When a domain is designated with a "+," for example "EIII+" or "JEIII+," the portion of the envelope protein referenced as "III" is one component of the total of that domain plus at least one of at least a portion of either or both of domains I and II. For example, "EIII+," as used herein, means the compositions, fusion proteins and polypeptides of the invention include domain III and at least a portion of domain I. "EIII+" is also referred to as "EI/III." "JEIII+" is also referred to as "JEI/III." Similarly, when compositions include domains of envelope proteins of flavivirus, the domains can be any combination of domains I, II, and III and can be designated based on the domain. For example, EI/II includes domain I and II of the West Nile flavivirus. The absence of a "+" in reference to a domain (e.g., EIII, JEIII, Den1 III) of an envelope protein employed in the compositions, fusion proteins and polypeptides of the invention means that the composition, fusion protein and polypeptide includes the referenced domain. For example, "Den1 III" means the compositions, fusion proteins and compositions include domain III, not domains I and II, of the Dengue 1 virus.

The West Nile viral envelope protein can include at least a portion of at least one member selected from the group consisting of SEQ ID NO: 610, which is an EIII+ amino acid sequence, the italicized amino acids are domain I of the envelope protein and the remaining sequence is domain III of the envelope protein; SEQ ID NO: 611, West Nile virus, Stanford, Conn., also referred to as "West Nile S"; SEQ ID NO: 612, West Nile virus, New York, N.Y., also referred to as "West Nile NY"; and SEQ ID NO: 613, SEQ ID NO: 610 is encoded by SEQ ID NO: 614.

The Langat virus envelope protein for use in the compositions, fusion proteins and polypeptides of the invention can include at least a portion of SEQ ID NO: 615. The Kunjin virus envelope protein can include at least a portion of SEQ ID NO: 616. The Murray Valley encephalitis envelope protein can include at least a portion of SEQ ID NO: 617. The Japanese encephalitis envelope protein can include at least one member selected from the group consisting of at least a portion of SEQ ID NO: 618 and SEQ ID NO: 619. The Tick-borne encephalitis envelope protein can include at least a portion of SEQ ID NO: 620. The Yellow fever virus envelope protein can include at least a portion of SEQ ID NO: 621. The envelope protein of a flavivirus can include at least a portion of at least one member selected from the group consisting of SEQ ID NO: 622 and SEQ ID NO: 643. SEQ ID NOS: 615, 616, 617, 618, 619, 620, 621, 622 and 643 are portions of domain III of the viral envelope protein.

The antigen can be chemically conjugated to flagellin components and Toll-like Receptor agonist components. Chemical conjugation (also referred to herein as "chemical coupling") can include conjugation by a reactive group, such as a thiol group (e.g., a cysteine residue) or by derivatization of a primary (e.g., a amino-terminal) or secondary (e.g., lysine) group. Different crosslinkers can be used to chemically conjugate-TLR ligands (e.g., TLR agonists) to proteins (e.g., antigens, compositions of the invention, HA and M2e constructs of the invention) or other molecules (e.g., nucleic acids, polysaccharides). Exemplary cross linking agents are commercially available, for example, from Pierce (Rockland, Ill.). Methods to chemically conjugate the antigen to the flagellin component are well-known and include the use of commercially available cross-linkers, such as those described herein.

For example, conjugation of peptide or protein antigens to a flagellin component or a Toll-like Receptor agonist component of the invention can be through at least one cysteine residue of the flagellin component or the Toll-like Receptor component and at least one cysteine residue of a protein (e.g., an influenza antigen, such as HA, M2e) employing established techniques. The protein can be derivatized with a homobifunctional, sulfhydryl-specific crosslinker; the protein is then desalted to remove the unreacted crosslinker; and then the peptide or protein partner added and conjugated via at least one cysteine residue cysteine. Exemplary reagents for use in the conjugation methods can be purchased commercially from Pierce (Rockland, Ill.), for example, BMB (Catalog No: 22331), BMDB (Catalog No: 22332), BMH (Catalog No: 22330), BMOE (Catalog No: 22323), BM[PEO]$_3$ (Catalog No: 22336), BM[PEO]$_4$ (Catalog No: 22337), DPDPB (Catalog No: 21702), DTME (Catalog No: 22335), HBVS (Catalog No: 22334).

Alternatively, cysteine-containing proteins and antigens can also be conjugated to lysine residues on flagellin components, flagellin, Toll-like Receptor agonist components and Toll-like Receptor agonists of the invention. A protein containing no cysteine residues is derivatized with a heterobifunctional amine and sulfhydryl-specific crosslinker. After desalting, the cysteine-containing partner is added and conjugated. Exemplary reagents for use in the conjugation methods can be purchased from Pierce (Rockland, Ill.), for example, AMAS (Catalog No: 22295), BMPA (Catalog No. 22296), BMPS (Catalog No: 22298), EMCA (Catalog No: 22306), EMCS (Catalog No: 22308), GMBS (Catalog No: 22309), KMUA (Catalog No: 22211), LC-SMCC (Catalog No: 22362), LC-SPDP (Catalog No: 21651), MBS (Catalog No: 22311), SATA (Catalog No: 26102), SATP (Catalog No: 26100), SBAP (Catalog No: 22339), SIA (Catalog No: 22349), SIAB (Catalog No: 22329), SMCC (Catalog No: 22360), SMPB (Catalog No: 22416), SMPH (Catalog No. 22363), SMPT (Catalog No: 21558), SPDP (Catalog No: 21857), Sulfo-EMCS (Catalog No: 22307), Sulfo-GMBS (Catalog No: 22324), Sulfo-KMUS (Catalog No: 21111), Sulfo-LC-SPDP (Catalog No: 21650), Sulfo-MBS (Catalog No: 22312), Sulfo-SIAB (Catalog No: 22327), Sulfo-SMCC (Catalog No: 22322), Sulfo-SMPB (Catalog No: 22317), Sulfo-LC-SMPT (Catalog No.: 21568).

Additionally, or alternatively, peptide or protein antigens can also be conjugated to flagellin components or Toll-like Receptor agonist components of the invention via at least one lysine residue on both conjugate partners. The two conjugate partners are combined along with a homo-bifunctional amine-specific crosslinker. The appropriate hetero-conjugate is then purified away from unwanted aggregates and homo-conjugates. Exemplary reagents for use in the conjugation methods can be purchased from Pierce (Rockland, Ill.), for example, BSOCOES (Catalog No: 21600), BS$_3$ (Catalog No: 21580), DFDNB (Catalog No: 21525), DMA (Catalog No: 20663), DMP (Catalog No: 21666), DMS (Catalog No: 20700), DSG (Catalog No: 20593), DSP (Catalog No: 22585), DSS (Catalog No: 21555), DST (Catalog No: 20589), DTBP (Catalog No: 20665), DTSSP (Catalog No: 21578), EGS (Catalog No: 21565), MSA (Catalog No: 22605), Sulfo-DST (Catalog No: 20591), Sulfo-EGS (Catalog No: 21566), THPP (Catalog No: 22607).

Similarly, peptide or protein antigens can be conjugated to flagellin components or Toll-like Receptor agonist components of the invention via at least one carboxyl group (e.g., glutamic acid, aspartic acid, or the carboxy-terminus of the peptide or protein) on one partner and amines on the other partner. The two conjugation partners are mixed together along with the appropriate heterobifunctional crosslinking reagent. The appropriate hetero-conjugate is then purified away from unwanted aggregates and homo-conjugates. Exemplary reagents for use in the conjugation methods can be purchased from Pierce (Rockland, Ill.), for example, AEDP (Catalog No: 22101), EDC (Catalog No: 22980) and TFCS (Catalog No: 22299).

In addition, carbohydrate antigens can be conjugated to proteins, flagellin components, flagellin, Toll-like Receptor agonist components and Toll-like Receptor agonists of the invention via at least one cysteine residue in the protein employing well-established techniques. For example, the protein is initially derivatized with a heterobifunctional crosslinker containing at least one sulfhydryl-specific group and at least one hydrazide group. The polysaccharide or oligosaccharide is then treated with an oxidizing agent such as sodium meta-periodate to generate terminal aldehyde groups. The oxidized carbohydrate is then added to the derivatized protein and conjugation to the aldehyde occurs via the hydrazide on the crosslinker. Exemplary reagents for use in the conjugation methods can be purchased from Pierce (Rockland, Ill.), for example, BMPH (Catalog No: 22297), EMCH (Catalog No: 22106), KMUH (Catalog No: 22111) and PDPH (Catalog No: 22301).

Further lipopeptides can be conjugated to protein antigens flagellin components or Toll-like Receptor components or Toll-like Receptor agonists of the invention via amino-acid side chains on the peptide chain. Similar strategies and reagents, as described above for peptide conjugation to proteins, would be employed.

TLRs can be activated by nucleic acids. For example, TLR3 is activated by double-stranded (ds) RNA; TLR7 and TLR8 are activated by single-stranded (ss) RNA; and TLR9 is activated by CpG DNA sequences. Several different techniques can be employed to conjugate Toll-like Receptor agonist components of nucleic acid TLRs to protein antigens. For example, for un-modified DNA molecule, the 5' phosphate group can be modified with the water-soluble carbodiimide EDC (Pierce; Rockford, Ill., Catalog No: 22980) followed by imidazole to form a terminal phosphoylimidazolide. A terminal amine can then be substituted for this reactive group by the addition of ethylenediamine. The amine-modified nucleic acid can then be conjugated to a cysteine on a protein using a heterobifunctional maleimide (cysteine-specific) and NHS-ester (lysine-specific) crosslinker, as described above for peptide-protein conjugation.

Alternatively, or additionally, a sulfhydryl group can be incorporated at the 5' end by substituting cystamine for ethylenediamine in the second step. After reduction of the disulfide bond, the free sulfhydryl can be conjugated to cysteines on proteins, flagellin components, flagellin, Toll-like Receptor agonist components and Toll-like Receptor agonists employing a homo-bifunctional maleimide-based crosslinker, or to lysines using a heterobifunctional crosslinker, as described above. Alternately, or additionally, synthetic oligonucleotides can be synthesized with modified bases on either the 5' or 3' end. These modified bases can include primary amine or sulfhydryl groups which can be conjugated to proteins using the methods described above. The 3' end of RNA molecules may be chemically modified to allow coupling with proteins or other macromolecules. The diol on the 3'-ribose residue may be oxidized using sodium meta-periodate to produce an aldehyde group. The aldehyde may then be conjugated to proteins using a hydrazide-containing crosslinker, such as MPBH (Pierce; Rockland, Ill., Catalog No: 22305), which covalently modifies the carbonyl group, and then conjugates to free, thiols on proteins via a maleimide group. Alternatively, the 3' hydroxyl group may be derivatized directly with an isocyanate-containing crosslinker, such as PMPI (Pierce; Rockland, Ill., Catalog No: 28100), which also contains a maleimide group for conjugation to protein sulfhydryls.

Synthetic small-molecule TLR ligands (e.g., Toll-like Receptor agonists, Toll-like Receptor antagonists) have been identified. For example, imiquimod, which potently activates TLR7, and resiquimod, an activator of both TLR7 and TLR8. Analogs of these compounds with varying levels of potency and specificity have been synthesized. The ability to conjugate a small molecule TLR agonist to an antigen of interest can depend on the chemical nature of the TLR ligand. Some TLR ligands may have active groups that can be exploited for chemical conjugation. For example, imiquimod, as well as its analog gardiquimod (InvivoGen: San Diego, Calif.) and the TLR7-activating adenine analog CL087 (InvivoGen, San Diego, Calif.), have primary amine groups ($-NH_2$), which can be targets for derivatization by crosslinkers containing imidoesters or NHS esters. In another strategy, gardiquimod contains an exposed hydroxyl (—OH) group, which can be derivatized by an isocyanate-containing crosslinker, such as PMPI (Pierce; Rockland, Ill. Catalog No: 28100) for subsequent crosslinking to protein sulfhydryl groups.

In addition, custom synthesis of derivatives of small-molecule TLR ligands can be arranged in order to attach novel functional groups at different positions in the molecule to facilitate crosslinking. Custom derivatives can also include groups, such as maleimides, which can then be used for direct linking to protein antigens.

Chemical conjugation of an antigen to the flagellin component can result in increased aqueous solubility of the antigen (e.g., an essentially hydrophobic antigen, such as a maturational cleavage site antigen) as a component of the composition.

The composition comprising a flagellin component that is at least a portion of a flagellin, wherein the flagellin component includes at least one cysteine residue and whereby the flagellin component activates a Toll-like Receptor 5 can include a cysteine residue in the hypervariable region of the flagellin component.

At least one cysteine residue substitutes for at least one amino acid in a naturally occurring flagellin amino acid sequence flagellin component. The cysteine residue can substitute for at least one amino acid selected from the group consisting of amino acid 1, 237, 238, 239, 240, 241 and 495 of SEQ ID NO: 812; at least one amino acid selected from the group consisting of amino acid 1, 240, 241, 242, 243, 244 and 505 of SEQ ID NO: 498; at least one amino acid selected from the group consisting of amino acid 1, 237, 238, 239, 240, 241 and 504 of SEQ ID NO: 504; at least one amino acid selected from the group consisting of amino acid 1, 211, 212, 213 and 393 of SEQ ID NO: 815; at least one amino acid selected from the group consisting of amino acid 1, 151, 152, 153, 154 and 287 of SEQ ID NO: 820; at least one amino acid selected from the group consisting of amino acid 1, 238, 239, 240, 241, 242, 243 and 497 of SEQ ID NO: 502; at least one amino acid selected from the group consisting of amino acid 1, 237, 238, 239, 240, 241 and 495 of SEQ ID NO: 812.

The flagellin component or Toll-like Receptor agonist component can include at least a portion of a naturally occurring flagellin amino acid sequence in combination with the cysteine residue.

Figure 75:
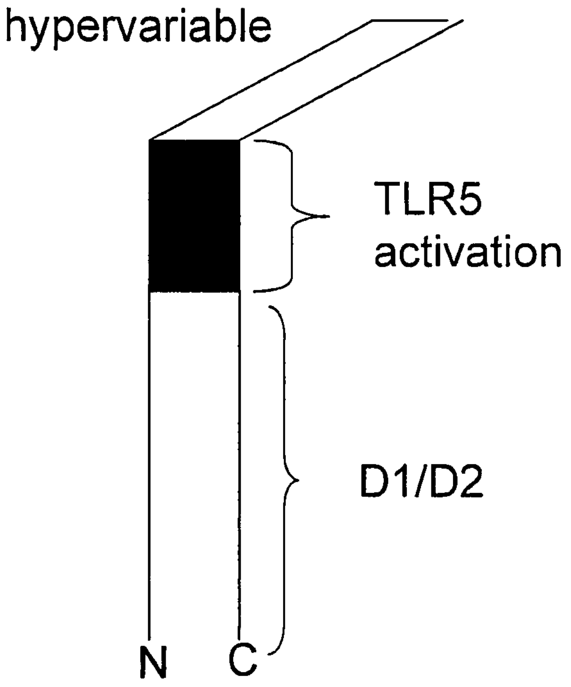
FIG. 75 depicts the D1 domain, D2 domain, TLR5 activation domain and hypervariable (D3 domain) of flagellin.
Figure 76:
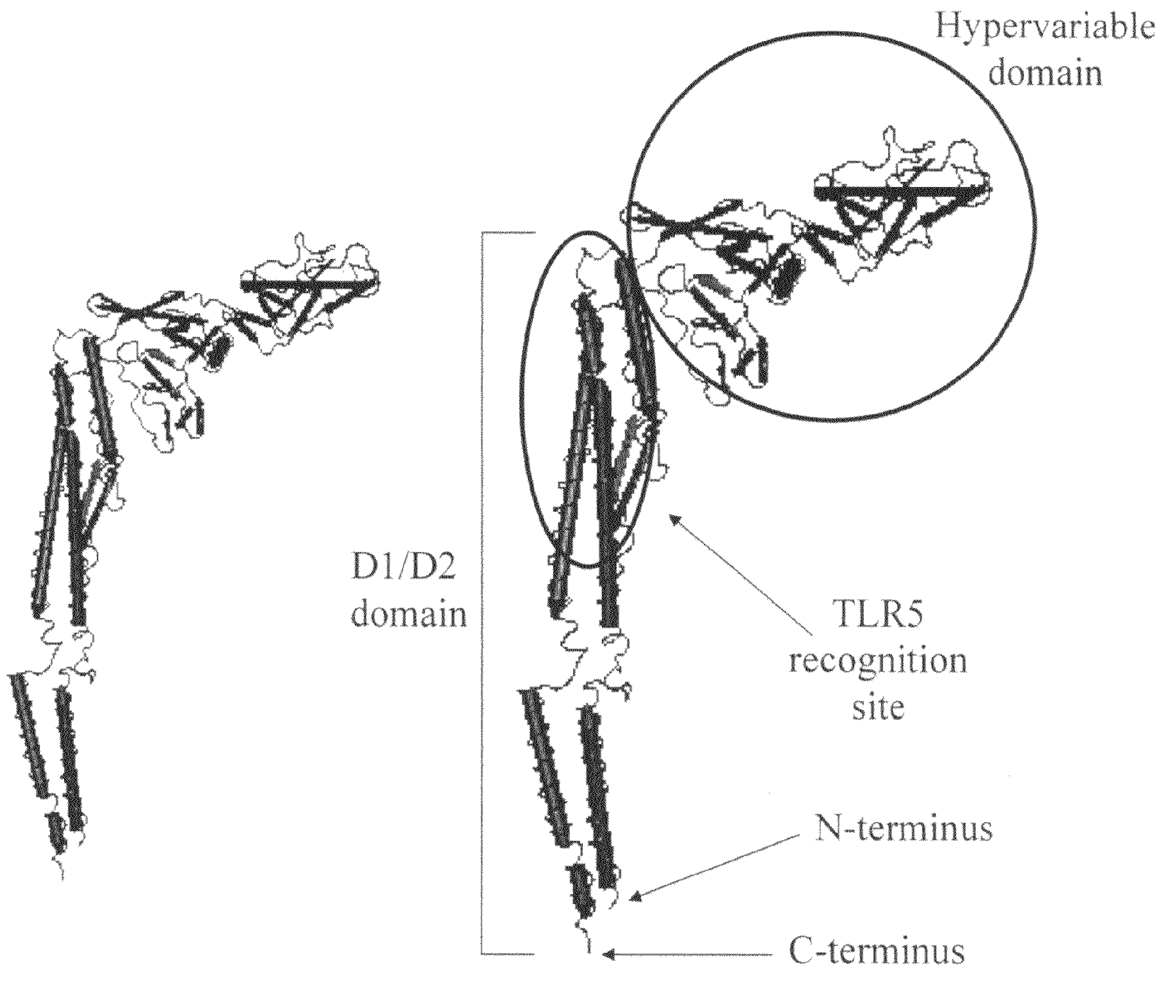
FIG. 76 depicts the D1 domain, D2 domain, TLR5 activation domain and hypervariable (D3 domain) of flagellin (Yonekura, et al. *Nature* 424, 643-650 (2003)).

The composition of the invention wherein the cysteine residue substitutes for at least one amino acid in a naturally occurring flagellin amino acid sequence flagellin component, or wherein the flagellin component includes at least a portion of a naturally occurring flagellin amino acid sequence in combination with the cysteine residue, can activate a Toll-like Receptor 5. For example, a cysteine residue can be placed within the D1/D2 domain proximate to the amino-terminus and carboxy-terminus, remote to the TLR5 recognition site (see, for example, FIGS. 75 and 76). Alternatively, or additionally, the cysteine residue can be placed at the distal point of the hypervariable domain (see, for example, FIGS. 75 and 76) at about amino acid 237, about 238, about 239, about 240 and about 241 of SEQ ID NO: 812. Substituting polar or charged amino acids is preferable to substituting hydrophobic amino acids with cysteine residues. Substitution within the TLR5 recognition site is least preferable.

Flagellin from *Salmonella typhimurium* STF1 (FliC) is depicted, in SEQ ID NO: 812 (Accession No: P06179). The TLR5 recognition site is amino acid about 79 to about 117 and about 408 to about 439. Cysteine residues can substitute for or be included in combination with amino acid about 408 to about 439 of SEQ ID NO: 812; amino acids about 1 and about 495 of SEQ ID NO: 812; amino acids about 237 to about 241 of SEQ ID NO: 812; and/or amino acids about 79 to about 117 and about 408 to about 439 of SEQ ID NO: 812.

*Salmonella typhimurium* flagellin STF2 (FljB) is depicted in SEQ ID NO: 498. The TLR5 recognition site is amino acids about 80 to about 118 and about 420 to about 451 of SEQ ID NO: 498. Cysteine residues can substitute for or be included in combination with amino acids about 1 and about 505 of SEQ ID NO: 498; amino acids about 240 to about 244 of SEQ ID NO: 498; amino acids about 79 to about 117 and/or about 419 to about 450 of SEQ ID NO: 498.

*Salmonella muenchen* flagellin is depicted in SEQ ID NO: 504 (Accession No: #P06179). The TLR5 recognition site is amino acids about 79 to about 117 and about 418 to about 449 of SEQ ID NO: 504. Cysteine residues can substitute for or be included in combination with amino acids about 1 and about 504 of SEQ ID NO: 504; about 237 to about 241 of SEQ ID NO: 504; about 79 to about 117; and/or about 418 to about 449 of SEQ ID NO: 504.

*Escherichia coli* flagellin is depicted in SEQ ID NO: 502 (Accession No: P04949). The TLR5 recognition site is amino acids about 79 to about 117 and about 410 to about 441 of SEQ ID NO: 502. Cysteine residues can substitute for or be included in combination with amino acids about 1 and about 497 of SEQ ID NO: 502; about 238 to about 243 of SEQ ID NO: 502; about 79 to about 117; and/or about 410 to about 441 of SEQ ID NO: 502.

*Pseudomonas auruginosa* flagellin is depicted in SEQ ID NO: 815. The TLR5 recognition site is amino acids about 79 to about 114 and about 308 to about 338 of SEQ ID NO: 815. Cysteine residues can substitute for or be included in combination with amino acids about 1 and about 393 of SEQ ID NO: 815; about 211 to about 213 of SEQ ID NO: 815; about 79 to about 114; and/or about 308 to about 338 of SEQ ID NO: 815.

*Listeria monocytogenes* flagellin is depicted in SEQ ID NO: 820. The TLR5 recognition site is amino acids about 78 to about 116 and about 200 to about 231 of SEQ ID NO: 820. Cysteine residues can substitute for or be included in combination with amino acids about 1 and about 287 of SEQ ID NO: 820; about 151 to about 154 of SEQ ID NO: 820; about 78 to about 116; and/or about 200 to about 231 of SEQ ID NO: 820.

Experimentally defined TLR5 recognition sites on STF2 have been described (see, for example, Smith, K. D., et al., *Nature Immunology* 4:1247-1253 (2003) at amino acids about 79 to about 117 and about 420 to about 451. In addition, Smith, K. D., et al, *Nature Immunology* 4:1247-1253 (2003), based on sequence homology, identified TLR5 recognition sites on other flagellins, such as STF1 at amino acids about 79 to about 117, about 408 to about 439; *P. aeruginosa* at amino acids about 79 to about 117, about 308 to about 339; *L. pneumophila* at amino acids about 79 to about 117, about 381 to about 419; *E. coli* at amino acids about 79 to about 117, about 477, about 508; *S. marcesens* at amino acids about 79 to about 117, about 265-about 296; *B. subtilus* at amino acids about 77 to about 117, about 218 to about 249; and *L. monocytogenes* at amino acids about 77 to about 115, about 200 to about 231.

The high-resolution structure STF1 (FliC) (SEQ ID NO: 812) has been determined and can be a basis for analysis of TLR5 recognition by a flagellin and the location of cysteine substitutions/additions. Flagellin resembles a "boomerang," with the amino- and carboxy-termini at the end of one arm (see, for example FIG. 77). The TLR5 recognition site is located roughly on the outer side of the boomerang just below the bend toward the amino- and carboxy-termini of the flagellin. The hinge region, which is not required for TLR5 recognition, is located above the bend. The region of greatest sequence homology of flagellins is in the TLR5 recognition site. The next region of sequence homology is in the D1 and D2 domains, which include the TLR5 recognition site and the amino- and carboxy-termini. The D1 and D2 domains, with or without a linker, is STF2Δ (SEQ ID NO: 500), which can activate TLR5. The region of least sequence homology between flagellins is the hypervariable region.

It is believed that the ability of the flagellin component or Toll-like Receptor agonist component to activate TLR5 can be accomplished by maintaining the conjugation sites (cysteine residues substituted for at least one amino acid in a naturally occurring flagellin amino acid sequence flagellin component or at least a portion of a naturally occurring flagellin amino acid sequence in combination with the cysteine residue) remote from the TLR5 or TLR recognition site. For example, for STF1 (SEQ ID NO: 812), for which a high resolution structural determination is available, this may be achieved in the D1 domain, D2 domain or in the hinge region. In the D1/D2 domain the amino- and carboxy-termini can be remote (also referred to herein as "distal") from the TLR5 recognition site, and moving away from either the amino or carboxy terminus may bring the conjugation site closer to the recognition site and may interfere with TLR5 activity. In the hinge region amino acids about 237 to about 241 of SEQ ID NO: 812, are approximately at the other tip of the "boomerang" and are about the same distance from the TLR5 recognition site as the amino- and carboxy-termini. This site may also be a location that maintains TLR5 recognition.

Amino acid identity can be taken into consideration for the location of conjugation sites. Polar and charged amino acids (e.g., serine, aspartic acid, lysine) are more likely to be surface exposed and amenable to attachment of an antigen. Hydrophobic amino acids (e.g., valine, phenylalanine) are more likely to be buried and participate in structural interactions and should be avoided.

Compositions that include flagellin components with cysteine residues or Toll-like Receptor agonist components with cysteine residues activate TLR5 and can be chemically conjugated to antigens.

The compositions and methods of employing the compositions of the invention can further include a carrier protein. The carrier protein can be at least one member selected from the group consisting of a tetanus toxoid, a *Vibrio cholerae* toxoid, a diphtheria toxoid, a cross-reactive mutant of diphtheria toxoid, a *E. coli* B subunit of a heat labile enterotoxin, a tobacco mosaic virus coat protein, a rabies virus envelope protein, a rabies virus envelope glycoprotein, a thyroglobulin, a heat shock protein 60, a keyhole limpet hemocyanin and an early secreted antigen tuberculosis-6.

The composition comprising a flagellin component that is at least a portion of a flagellin, wherein the flagellin component includes at least one cysteine residue and whereby the flagellin component activates a Toll-like Receptor 5 can include at least one lysine of the flagellin component that has been substituted with at least one member selected from the group consisting of an arginine residue, a serine residue and a histidine residue.

In an additional embodiment, the invention is a composition comprising a Toll-like Receptor agonist component that is at least a portion of a Toll-like Receptor agonist, wherein the Toll-like Receptor agonist component includes at least one cysteine residue in a position where a cysteine residue does not occur in the native Toll-like Receptor agonist, whereby the Toll-like Receptor agonist component activates a Toll-like Receptor. "Component," as used herein in reference to a Toll-like Receptor agonist component, means at least part of or the entirety of a Toll-like Receptor agonist.

In one embodiment, the cysteine residue in the composition comprising a Toll-like Receptor agonist component that is at least a portion of a Toll-like Receptor agonist, wherein the Toll-like Receptor agonist component includes at least one cysteine residue in a position where a cysteine residue does not occur in the native Toll-like Receptor agonist, whereby the Toll-like Receptor agonist component activates a Toll-like Receptor, substitutes for at least one amino acid in a naturally occurring amino acid sequence of a Toll-like Receptor agonist component. The cysteine can substitute for at least one amino acid remote to the Toll-like Receptor recognition site of the Toll-like Receptor agonist component.

In another embodiment, the Toll-like Receptor agonist component includes at least a portion of a naturally occurring Toll-like Receptor agonist amino acid sequence in combination with a cysteine residue. The cysteine residue in combination with the naturally occurring Toll-like Receptor agonist can be remote to the Toll-like Receptor recognition site of the Toll-like Receptor agonist component.

The composition comprising a Toll-like Receptor agonist component that is at least a portion of a Toll-like Receptor agonist, wherein the Toll-like Receptor agonist component includes at least one cysteine residue in a position where a cysteine residue does not occur in the native Toll-like Receptor agonist, whereby the Toll-like Receptor agonist component activates a Toll-like Receptor can further include at least a portion of at least one antigen (e.g., an influenza antigen, such as a influenza integral membrane protein antigen, HA, HA1-1, HA1-2, M2, M2e).

In still another embodiment, the invention is a composition comprising a flagellin component that is at least a portion of a flagellin, wherein at least one lysine of the flagellin component has been substituted with at least one arginine, whereby the flagellin component activates a Toll-like Receptor 5.

"Substituted," as used herein in reference to the flagellin, flagellin component, Toll-like Receptor agonist or Toll-like Receptor agonist component, means that at least one amino acid, such as a lysine of the flagellin component, has been modified to another amino acid residue, for example, a conservative substitution (e.g., arginine, serine, histidine) to thereby form a substituted flagellin component or substituted Toll-like Receptor agonist component. The substituted flagellin component or substituted Toll-like Receptor agonist component can be made by generating recombinant constructs that encode flagellin with the substitutions, by chemical means, by the generation of proteins or peptides of at least a portion of the flagellin by protein synthesis techniques, or any combination thereof.

The lysine residue that is substituted with an amino acid (e.g., arginine, serine, histidine) can be at least one lysine residue selected from the group consisting of lysine 19, 41, 58, 135, 160, 177, 179, 203, 215, 221, 228, 232, 241, 251, 279, 292, 308, 317, 326, 338, 348, 357, 362, 369, 378, 384, 391 and 410 of SEQ ID NO: 812.

The flagellin can be a *S. typhimurium* flagellin that includes SEQ ID NO: 816. The lysine residue that is substituted with an amino acid (e.g., arginine, serine, histidine) can be at least one lysine residue selected from the group consisting of lysine 20, 42, 59, 136, 161, 177, 182, 189, 209, 227, 234, 249, 271, 281, 288, 299, 319, 325, 328, 337, 341, 355, 357, 369, 381, 390, 396, 403, 414 and 422 of SEQ ID NO: 816.

The flagellin can be an *E. coli* fliC that includes SEQ ID NO: 814. The flagellin can be a *S. muenchen* that include the includes SEQ ID NO: 813. The flagellin can be a *P. aeruginosa* flagellin that includes SEQ ID NO; 815. The flagellin can be a *Listeria monocytogenes* flagellin that includes SEQ ID NO: 820.

The compositions of the invention can include a flagellin that has lysines substituted in a region adjacent to the motif C of the flagellin, the motif N of the flagellin, both the motif C and the motif N of the flagellin, domain 1 of the flagellin, domain 2 of the flagellin or any combination thereof. Motif C and motif N of flagellin and domain 1 and domain 2 of the flagellin can be involved in activation of TLR5 by the flagellin (Murthy, et al., *J. Biol. Chem.,* 279:5667-5675 (2004)).

Chemical conjugation of a protein, peptide, or polypeptide to another molecule can be by derivatization of a secondary group, such as a lysine. Certain lysine residues in flagellin are near or in domain 1, the motif C or motif N, motifs can be important in binding of the flagellin to TLR5. For example, lysine residues at amino acids 58, 135, 160 and 410 of SEQ ID NO: 812 may be substituted with at least one member selected from the group consisting of an arginine residue, a serine residue and a histidine residue. Derivatization of such lysine residues to, for example, chemically conjugated antigens to flagellins, may decrease the ability or the binding affinity of the flagellin to TLR5 and, thus, diminish an innate immune response mediated by TLR5. Substitution of at least one lysine residue in a flagellin that may be near to regions of the flagellin that are important in mediating interactions with TLR5 (e.g., motif C, motif N, domain 1) with another amino acid (e.g., arginine, serine, histidine) may preserve or enhance flagellin binding to TLR5. In a particular embodiment, the amino acid substitution is a conservative amino acid substitution with at least one member selected from the group consisting of arginine, serine and histidine. Exemplary commercially available reagents for chemical conjugation are described herein.

Certain lysine residues in flagellin are in the domain (domain 1) and can be important for activation of TLR5. For example, lysine residues at positions 58, 135, 160 and 410 of SEQ ID NO: 812 are in domain 1. Derivatization of such lysine residues to, for example, chemically conjugated antigens, may decrease TLR5 bioactivity and, thus, diminish an innate immune response mediated by TLR5.

Lysine residues that can be substituted can include lysine residues implicated in TLR5 activation. Lysine residues in motif N (amino acids 95-108 of SEQ ID NO: 812) and/or motif C (amino acids 441-449 of SEQ ID NO: 812) can be suitable for substitution. Substitution of certain lysine residue in the flagellin (e.g., lysine at amino acid position 19, 41) with, for example, an arginine, serine or histidine, can maintain binding of the flagellin to TLR5 and leave other lysines available for chemical conjugate to another molecule, such as an antigen (e.g., protein) or another molecule, such as another protein, peptide or polypeptide.

The X-ray crystal structure of the F41 fragment of flagellin from *Salmonella typhimurium* shows the domain structure of flagellin (Samatey, F. A., et al., *Nature* 410:321 (2001)). The full length flagellin protein contains 4 domains, designated as D0, D1, D2 and D3. Three of these domains are shown in the crystal structure because the structure was made with a proteolytic fragment of full length flagellin. The amino acid sequences of *Salmonella typhimurium* flagellin for these regions, numbered relative to SEQ ID NO: 812 are as follows:

D0 contains the regions A1 through A55 and S451 through R494

D1 contains the regions N56 through Q176 and T402 through R450

D2 contains the regions K177 through G189 and A284 through A401

D3 contains the region Y190 though V283

Exemplary lysine residues of SEQ ID NO: 812 suitable for substitution with, for example, arginine, histidine, or serine, can include:

D0 contains 2 lysine residues; K19, K41

D1 contains 4 lysine residues; K58, K135, K160 and K410

D2 contains 14 lysine residues at positions 177, 179, 292, 308, 317, 326, 338, 348, 357, 362, 369, 378, 384, 391

D3 contains 8 lysine residues at positions 203, 215, 221, 228, 232, 241, 251, 279

Exemplary lysine residues suitable for substitution include lysines at positions 58, 135, 160 and 410 of SEQ ID NO: 812 (Jacchieri, S. G., et. al., *J. Bacteriol.* 185:4243 (2003); Donnelly, M. A., et al., *J. Biol. Chem.* 277:40456 (2002)). The sequences were obtained from the Swiss-Prot Protein Knowledgebase located online at http://us.expasy.org/sprot/. Lysine residues that can be modified are indicated with a *.

Exemplary lysine residues of SEQ ID NO: 816 suitable for substitution can include:

D0—with two lysines at positions 20, 42;

D1—with five lysines at positions 59, 136, 161, 414, 422;

D2—with sixteen lysines at positions 177, 182, 189, 299, 319, 325, 328, 337, 341, 355, 357, 369, 381, 390, 396, 403 and D3—with seven lysines at positions 209, 227, 234, 249, 271, 281, 288.

In a further embodiment, the invention is a composition comprising a flagellin component that is at least a portion of a flagellin, wherein at least one lysine of the flagellin component has been substituted with at least one histidine residue, whereby the flagellin component activates a Toll-like Receptor 5.

In yet another embodiment, the invention is a method of stimulating an immune response in a subject, comprising the step of administering to the subject a composition that includes a flagellin component that is at least a portion of a flagellin, wherein the flagellin component includes at least one cysteine residue and whereby the flagellin component activates a Toll-like Receptor 5.

In another embodiment, the invention is a method of stimulating protective immunity in a subject, comprising the step of administering to the subject a composition that includes a flagellin component that is at least a portion of a flagellin, wherein the flagellin component includes at least one cysteine residue and whereby the flagellin component activates a Toll-like Receptor 5.

In yet another embodiment, the invention is a method of stimulating protective immunity in a subject, comprising the step of administering to the subject a composition that includes a flagellin component that is at least a portion of a flagellin, wherein at least one lysine of the flagellin component has been substituted with at least one arginine, whereby the flagellin component activates a Toll-like Receptor 5.

In still another embodiment, the invention is a method of stimulating an immune response in a subject, comprising the step of administering to the subject a composition that includes a flagellin component that is at least a portion of a flagellin, wherein at least one lysine of the flagellin component has been substituted with at least one serine residue, whereby the flagellin component activates a Toll-like Receptor 5.

In another embodiment, the invention is a method of stimulating a protective immune response in a subject, comprising the step of administering to the subject a composition that includes a flagellin component that is at least a portion of a flagellin, wherein at least one lysine of the flagellin component has been substituted with at least one serine residue, whereby the flagellin component activates a Toll-like Receptor 5.

In an additional embodiment, the invention is a method of stimulating an immune response in a subject, comprising the step of administering to the subject a composition that includes a flagellin component that is at least a portion of a flagellin, wherein at least one lysine of the flagellin component has been substituted with at least one histidine residue, whereby the flagellin component activates a Toll-like Receptor 5.

In a further embodiment, the invention is a method of stimulating protective immunity in a subject, comprising the step of administering to the subject a composition that includes a flagellin component that is at least a portion of a flagellin, wherein at least one lysine of the flagellin component has been substituted with at least one histidine residue, whereby the flagellin component activates a Toll-like Receptor 5.

Another embodiment of the invention is a method of stimulating an immune response in a subject, comprising the step of administering to the subject a composition that includes a Toll-like Receptor agonist component that is at least a portion of a Toll-like Receptor agonist, wherein the Toll-like Receptor agonist component includes at least one cysteine residue in a position where a cysteine residue does not occur in the native Toll-like Receptor agonist, whereby the Toll-like Receptor agonist component activates a Toll-like Receptor agonist.

Another embodiment of the invention is a method of stimulating a protective immunity in a subject, comprising the step of administering to the subject a composition that includes a Toll-like Receptor agonist component that is at least a portion of a Toll-like Receptor agonist, wherein the Toll-like Receptor agonist component includes at least one cysteine residue in a position where a cysteine residue does not occur in the native Toll-like Receptor agonist, whereby the Toll-like Receptor agonist component activates a Toll-like Receptor agonist.

In yet another embodiment, the invention is a composition comprising an antigen component that includes at least a portion of a hemagglutinin maturational cleavage site and an agonist component that includes a Toll-like Receptor agonist (e.g., at least one member selected from the group consisting of a Toll-like Receptor 1 agonist, a Toll-like Receptor 3 agonist, a Toll-like Receptor 5 agonist, a Toll-like Receptor 6 agonist, a Toll-like Receptor 7 agonist and a Toll-like Receptor 9 agonist) wherein the Toll-like Receptor agonist is not a Toll-like Receptor 2 agonist (e.g., the outer membrane protein complex (OMPC), such as OMPC of *Neiserria meningitides*). The hemagglutinin maturational cleavage site can include at least one member selected from the group consisting of an influenza A hemagglutinin maturational cleavage site, an influenza B hemagglutinin maturational cleavage site and an influenza C hemagglutinin maturational cleavage site.

In one embodiment, the antigen component and the agonist component of the compositions of the invention can be components of a fusion protein. In another embodiment, the antigen component is chemically conjugated to the agonist component. The agonist component includes a composition comprising a flagellin component that is at least a portion of a flagellin, wherein the flagellin component includes at least one cysteine residue and whereby the flagellin component activates a Toll-like Receptor 5. The antigen component further includes at least a portion of a matrix 2 protein, which can further include a second agonist component that includes at least a portion of a second Toll-like Receptor agonist (e.g., at least a portion of at least one member selected from the group consisting of a Toll-like Receptor 2 agonist, a Toll-like Receptor 3 agonist, a Toll-like Receptor 4 agonist, a Toll-like Receptor 5 agonist, a Toll-like Receptor 6 agonist, a Toll-like Receptor 7 agonist and a Toll-like Receptor 9 agonist). The matrix-2 protein can be fused to the second agonist component or chemically conjugated to a second agonist component.

An "antigen component," as used herein, refers to a part or the entirety of an antigen.

An "agonist component" as used herein, refers to a part or the entirety of an agonist, such as a Toll-like Receptor agonist.

In an additional embodiment, the invention is a method of stimulating an immune response in a subject, comprising the step of administering to the subject a composition comprising an antigen component that includes at least a portion of a hemagglutinin maturational cleavage site and an agonist component that includes a Toll-like Receptor agonist, wherein the Toll-like Receptor agonist is not a Toll-like Receptor 2 agonist.

In a further embodiment, the invention is a method of stimulating protective immunity in a subject, comprising the step of administering to the subject a composition comprising an antigen component that includes at least a portion of a hemagglutinin maturational cleavage site and an agonist component that includes a Toll-like Receptor agonist, wherein the Toll-like Receptor agonist is not a Toll-like Receptor 2 agonist.

In yet another embodiment, the invention is a composition that includes at least a portion of a HA antigen (e.g., the maturational cleavage site) that is fused (e.g., recombinantly) to or chemically conjugated to at least of portion of a hinge region of a flagellin, a flagellin component or in a flagellin in which the hinge region has been deleted; and at least a portion of an M2e protein that is fused (e.g., recombinantly) to or chemically conjugated to a flagellin or a flagellin component, for example, at the amino- or carboxy-terminus of the flagellin or the flagellin component (See, for example, FIG. 77).

In an additional embodiment, the invention includes a protein, peptide polypeptide having at least about 70%, at least about 75%, at least about 80%, at least about 85%, at least about 90%, at least about 95%, at least about 98% and at least about 99% sequence identity to the proteins, polypeptides and peptides of the invention.

The percent identity of two amino acid sequences (or two nucleic acid sequences) can be determined by aligning the sequences for optimal comparison purposes (e.g., gaps can be introduced in the sequence of a first sequence). The amino acid sequence or nucleic acid sequences at corresponding positions are then compared, and the percent identity between the two sequences is a function of the number of identical positions shared by the sequences (i.e., % identity=# of identical positions/total # of positions×100). The length of the protein or nucleic acid encoding can be aligned for comparison purposes is at least 30%, preferably, at least 40%, more preferably, at least 60%, and even more preferably, at least 70%, 75%, 80%, 85%, 90%, 95%, 98%, 99% or 100%, of the length of the reference sequence, for example, the nucleic acid sequence of a protein portion of HA (e.g., HA1-1, HA1-2), fusion protein, antigen, or polypeptide.

The actual comparison of the two sequences can be accomplished by well-known methods, for example, using a mathematical algorithm. A preferred, non-limiting example of such a mathematical algorithm is described in Karlin et al. (*Proc. Natl. Acad. Sci. USA,* 90:5873-5877 (1993), the teachings of which are hereby incorporated by reference in its entirety). Such an algorithm is incorporated into the BLASTN and BLASTX programs (version 2.2) as described in Schaffer et al. (*Nucleic Acids Res.,* 29:2994-3005 (2001), the teachings of which are hereby incorporated by reference in its entirety). When utilizing BLAST and Gapped BLAST programs, the default parameters of the respective programs (e.g., BLASTN; available at the Internet site for the National Center for Biotechnology Information) can be used. In one embodiment, the database searched is a non-redundant (NR) database, and parameters for sequence comparison can be set at: no filters; Expect value of 10; Word Size of 3; the Matrix is BLOSUM62; and Gap Costs have an Existence of 11 and an Extension of 1.

Another mathematical algorithm employed for the comparison of sequences is the algorithm of Myers and Miller, CABIOS (1989), the teachings of which are hereby incorporated by reference in its entirety. Such an algorithm is incorporated into the ALIGN program (version 2.0), which is part of the GCG (Accelrys, San Diego, Calif.) sequence alignment software package. When utilizing the ALIGN program for comparing amino acid sequences, a PAM120 weight residue table, a gap length penalty of 12, and a gap penalty of 4 is used. Additional algorithms for sequence analysis are known in the art and include ADVANCE and ADAM as described in Torellis and Robotti (Comput. Appl. Biosci., 10: 3-5 (1994), the teachings of which are hereby incorporated by reference in its entirety); and FASTA described in Pearson and Lipman (*Proc. Natl. Acad. Sci. USA,* 85: 2444-2448 (1988), the teachings of which are hereby incorporated by reference in its entirety).

The percent identity between two amino acid sequences can also be accomplished using the GAP program in the GCG software package (Accelrys, San Diego, Calif.) using either a Blossom 63 matrix or a PAM250 matrix, and a gap weight of 12, 10, 8, 6, or 4 and a length weight of 2, 3, or 4. In yet another embodiment, the percent identity between two nucleic acid sequences can be accomplished using the GAP program in the GCG software package (Accelrys, San Diego, Calif.), using a gap weight of 50 and a length weight of 3.

The nucleic acid sequence encoding a protein portion of HA, polypeptide or fusion proteins of the invention and polypeptides of the invention can include nucleic acid sequences that hybridize to nucleic acid sequences or complements of nucleic acid sequences of the invention, for example, SEQ ID NOS: 53-58, 64, 68, 71, 72, 73, 76, 78, 80, 84, 87, 104, 107, 110, 111, 112, 115, 116, 117, 119, 120, 121, 122, 123, 124, 125, 126, 127, 128, 129, 130, 131, 132, 133, 137, 139, 142, 143, 146, 147, 150, 167, 184, 185, 186, 187, 188, 189, 190, 191, and 192); and nucleic acid sequences that encode amino acid sequences and fusion proteins of the invention (e.g., SEQ ID NOS: 89-92, 95, 151-160, 177, 209, 210 and 211) under selective hybridization conditions (e.g., highly stringent hybridization conditions). As used herein, the terms "hybridizes under low stringency," "hybridizes under medium stringency," "hybridizes under high stringency," or "hybridizes under very high stringency conditions," describe conditions for hybridization and washing of the nucleic acid sequences. Guidance for performing hybridization reactions, which can include aqueous and nonaqueous methods, can be found in Aubusel, F. M., et al., Current Protocols in Molecular Biology, John Wiley & Sons, N.Y. (2001), the teachings of which are hereby incorporated herein in its entirety.

For applications that require high selectivity, relatively high stringency conditions to form hybrids can be employed. In solutions used for some membrane based hybridizations, addition of an organic solvent, such as formamide, allows the reaction to occur at a lower temperature. High stringency conditions are, for example, relatively low salt and/or high temperature conditions. High stringency are provided by about 0.02 M to about 0.10 M NaCl at temperatures of about 50° C. to about 70° C. High stringency conditions allow for limited numbers of mismatches between the two sequences. In order to achieve less stringent conditions, the salt concentration may be increased and/or the temperature may be decreased. Medium stringency conditions are achieved at a salt concentration of about 0.1 to 0.25 M NaCl and a temperature of about 37° C. to about 55° C., while low stringency conditions are achieved at a salt concentration of about 0.15 M to about 0.9 M NaCl, and a temperature ranging from about 20° C. to about 55° C. Selection of components and conditions for hybridization are well-known to those skilled in the art and are reviewed in Ausubel et al. (1997, Short Protocols in Molecular Biology, John Wiley & Sons, New York N.Y., Units 2.8-2.11, 3.18-3.19 and 4-64.9).

A "subject," as used herein, can be a mammal, such as a primate or rodent (e.g., rat, mouse). In a particular embodiment, the subject is a human.

An "effective amount," when referring to the amount of a composition and fusion protein of the invention, refers to that amount or dose of the composition and fusion protein, that, when administered to the subject is an amount sufficient for therapeutic efficacy (e.g., an amount sufficient to stimulate an immune response in the subject). The compositions and fusion proteins of the invention can be administered in a single dose or in multiple doses.

The methods of the present invention can be accomplished by the administration of the compositions and fusion proteins of the invention by enteral or parenteral means. Specifically, the route of administration is by oral ingestion (e.g., drink, tablet, capsule form) or intramuscular injection of the composition and fusion protein. Other routes of administration as also encompassed by the present invention including intravenous, intradermal, intraarterial, intraperitoneal, or subcutaneous routes, and nasal administration. Suppositories or transdermal patches can also be employed.

The compositions and fusion proteins of the invention can be administered ex vivo to a subject's autologous dendritic cells. Following exposure of the dendritic cells to the composition and fusion protein of the invention, the dendritic cells can be administered to the subject.

The compositions and fusion proteins of the invention can be administered alone or can be coadministered to the patient. Coadministration is meant to include simultaneous or sequential administration of the composition, fusion protein or polypeptide of the invention individually or in combination. Where the composition and fusion protein are administered individually, the mode of administration can be conducted sufficiently close in time to each other (for example, administration of the composition close in time to administration of the fusion protein) so that the effects on stimulating an immune response in a subject are maximal. It is also envisioned that multiple routes of administration (e.g., intramuscular, oral, transdermal) can be used to administer the compositions and fusion proteins of the invention.

The compositions and fusion proteins of the invention can be administered alone or as admixtures with conventional excipients, for example, pharmaceutically, or physiologically, acceptable organic, or inorganic carrier substances suitable for enteral or parenteral application which do not deleteriously react with the extract. Suitable pharmaceutically acceptable carriers include water, salt solutions (such as Ringer's solution), alcohols, oils, gelatins and carbohydrates such as lactose, amylose or starch, fatty acid esters, hydroxymethylcellulose, and polyvinyl pyrrolidine. Such preparations can be sterilized and, if desired, mixed with auxiliary agents such as lubricants, preservatives, stabilizers, wetting agents, emulsifiers, salts for influencing osmotic pressure, buffers, coloring, and/or aromatic substances and the like which do not deleteriously react with the compositions, fusion proteins or polypeptides of the invention. The preparations can also be combined, when desired, with other active substances to reduce metabolic degradation. The compositions and fusion proteins of the invention can be administered by is oral administration, such as a drink, intramuscular or intraperitoneal injection or intranasal delivery. The compositions and fusion proteins alone, or when combined with an admixture, can be administered in a single or in more than one dose over a period of time to confer the desired effect (e.g., alleviate prevent viral infection, to alleviate symptoms of virus infection, such as influenza or flaviviral infection).

When parenteral application is needed or desired, particularly suitable admixtures for the compositions and fusion proteins are injectable, sterile solutions, preferably oily or aqueous solutions, as well as suspensions, emulsions, or implants, including suppositories. In particular, carriers for parenteral administration include aqueous solutions of dextrose, saline, pure water, ethanol, glycerol, propylene glycol, peanut oil, sesame oil, polyoxyethylene-block polymers, and the like. Ampules are convenient unit dosages. The compositions, fusion proteins or polypeptides can also be incorporated into liposomes or administered via transdermal pumps or patches. Pharmaceutical admixtures suitable for use in the present invention are well-known to those of skill in the art and are described for example, in Pharmaceutical Sciences (17th Ed., Mack Pub. Co., Easton, Pa.) and WO 96/05309 the teachings of which are hereby incorporated by reference.

The compositions and fusion proteins of the invention can be administered to a subject on a support that presents the compositions, fusion proteins and polypeptides of the invention to the immune system of the subject to generate an immune response in the subject. The presentation of the compositions, fusion proteins and polypeptides of the invention would preferably include exposure of antigenic portions of the viral protein to generate antibodies. The components (e.g., PAMP and a viral protein) of the compositions, fusion proteins and polypeptides of the invention are in close physical proximity to one another on the support. The compositions and fusion proteins of the invention can be attached to the support by covalent or noncovalent attachment. Preferably, the support is biocompatible. "Biocompatible," as used herein, means that the support does not generate an immune response in the subject (e.g., the production of antibodies). The support can be a biodegradable substrate carrier, such as a polymer bead or a liposome. The support can further include alum or other suitable adjuvants. The support can be a virus (e.g., adenovirus, poxvirus, alphavirus), bacteria (e.g., *Salmonella*) or a nucleic acid (e.g., plasmid DNA).

The dosage and frequency (single or multiple doses) administered to a subject can vary depending upon a variety of factors, including prior exposure to an antigen, a viral protein, the duration of viral infection, prior treatment of the viral infection, the route of administration of the composition, fusion protein or polypeptide; size, age, sex, health, body weight, body mass index, and diet of the subject; nature and extent of symptoms of viral exposure, viral infection and the particular viral responsible for the infection (e.g., a flavivirus, influenza virus), or treatment or infection of an other antigen, such as an influenza antigen, kind of concurrent treatment, complications from the viral exposure, viral infection or exposure or other health-related problems. Other therapeutic regimens or agents can be used in conjunction with the methods and compositions, fusion proteins or polypeptides of the present invention. For example, the administration of the compositions and fusion proteins can be accompanied by other viral therapeutics or use of agents to treat the symptoms of a condition associated with or consequent to exposure to the antigen, such as flavivirus infection (e.g., high fever, numbness, DHF, meningoencephalitis) or influenza infection, for example. Adjustment and manipulation of established dosages (e.g., frequency and duration) are well within the ability of those skilled in the art.

Influenza viruses are single-stranded RNA viruses that belong to the viral family Orthomyxoviridae. Influenza viruses are divided into three types (A, B, C) determined by the antigenic differences in ribonucleoprotein (RNP) and matrix (M) antigens of the viruses. Influenza A virus naturally infects humans and several other mammalian species, including swine and horses, and a wide variety of avian species, and causes epidemics and pandemics in the human population. Influenza B virus appears to naturally infect only humans and can cause epidemics in humans. Influenza C virus has been isolated from humans and swine, but generally does not occur in epidemics and usually results in mild disease in humans.

Mature influenza virions are enveloped with a pleomorphic structure ranging in diameter from 80 to 120 μm. The single-stranded RNA genome is closely associated with a helical nucleoprotein and is present in seven (influenza C) or eight (influenza A and B) separate segments of ribonucleoprotein (RNP), each of which has to be present for successful replication of the virus. The segmented genome is enclosed within an outer lipoprotein envelope. Matrix protein 1 (MP1 or also referred to herein as "M1") lines the inside of the outer lipoprotein envelope and is bound to the RNP.

Hemagglutinin (HA) is a surface glycoprotein on a virus (e.g., an influenza virus) that is responsible for binding to N-AcetylNeuraminic Acid (NeuNAc; also referred to herein as "sialic acid") on host cells and subsequent fusion of viral and host membranes. HA acquired its name by virtue of its ability to cause red blood cells to clump, or agglutinate. Influenza HA is a trimer consisting of the three monomeric (HA0) subunits. HA performs two critical functions during the infection process: binding to a cell surface sialyloligosaccharide receptor and fusion of virus and host cell membrane. Following binding of the HA trimer to the plasma membrane of a host cell, the host cell membrane engulfs the virus in an endosome and attempts to digest the contents of the endosome by acidifying its interior and transferring it to a lysosome in the host cell. However, the acidic environment of the lysosome destabilizes HA, resulting in partial unfolding of HA0 which exposes a protease-sensitive site (the maturaional cleavage site) that is cleaved by a host protease to form HA1 and HA2 subunits which are connected by a single disulfide bond (Wiley, D. C., et al., *Annu. Rev. Biochem.* 56:365-394 (1987)). Cleavage occurs at a specific amino acid residue and generates a hydrophobic amino terminus for the HA2 subunit. This hydrophobic terminus of HA2 mediates fusion between the viral envelope and the endosomal membrane of the host cell and releases the contents of the virion into the cytoplasm of the cell, a process known as uncoating. Thus, cleavage of the HA polypeptide is a requirement for infectivity.

The crystal structure of several viral hemagglutinins has been determined (see, for example, Wilson, I. A., et al., *Nature* 289:366-373 (1981); Chen, J., et al., *Cell* 95:409-417 (1998); Ha, Y., et al., *The EMBO Journal* 21: 865-875 (2002); Russell, R. J., et al., *Virology* 325:287-296 (2004); and Cox, N. J., et al, In: Toply and Wilson's Microbiology and Microbial Infections, eds. B. W. J. Mathy, et al., Vol. 1 ($9^{th}$ ed.) New York, N.Y., Oxford Univ. Press, Ch. 32, p. 634 (1998)). X-ray crystallographic structures show that HA is folded into two structural components or domains—a globular head and a fibrous stalk (see, for example, FIG. 1). The globular head includes HA1, including that part of HA1 that binds to sialic acid (also referred to as the "receptor binding site or domain" or "sialic acid binding site or domain"), and antiparallel β-sheets. The fibrous stalk is more proximal to the viral membrane and consists of all of HA2 and part of HA 1, including the cleavage site between HA1 and HA2.

There are fifteen known subtypes of Influenza A HA (H1-H15) that share between about 40 to about 60% sequence identity (World Health Organization BULL. World Health Organ., 58:585-591 (1980)). Influenza viruses containing all 15 HA subtypes have been isolated from avian species (H5, H7, and H9), equine (H3 and H7), seals (H3, H4 and H7), whales (H1 and H13) and swine (H1, H3, and H9). Subtypes of influenza A virus are generally named according to the particular antigenic determinants of HA (H, 15 major types) and neuraminidase (N, about 9 major types). For example, subtypes include influenza A (H2N1), A(H3N2), A(H5N1), A(H7N2), A(H9N2), A(H1/H0), A(H3/H0) and A(H5/H0). In the last century, three subtypes of influenza A resulted in pandemics: H1 in 1918 and 1977; H2 in 1957 and H3 in 1968. In 1997, an H5 avian virus and in 1999, an H9 virus resulted in outbreaks of respiratory disease in Hong Kong. HA from influenza type B viruses have been isolated from humans and seals and are not divided into subtypes.

A host infected with influenza can mount an antibody response to the globular head of HA that protects that host from subsequent infection with the same strain of virus by blocking the interaction between HA and the host cell, i.e., neutralizing the infectivity of the virus. Due to the low fidelity and high rate of influenza RNA replication, the virus is constantly experiencing minor mutations in the HA gene that preserve the globular head structure and host cell interaction, but may allow progeny virus to escape immune surveillance. These point mutations are referred to as "antigenic drift." In addition, if a single host is simultaneously infected with two different strains of influenza A, a new subtype of virus may emerge as a result of reassortment, or the exchange of the RNA segments, or genes, between different strains of influenza A viruses. The viruses emerging from reassortment present the human immune system with a new antigenic experience that usually results in high morbidity and mortality. This type of drastic antigenic change is known as "antigenic shift." Since type B influenza viruses circulate almost exclusively in humans, these viruses cannot undergo reassortment with animal strains and, thus, are changed only by antigenic drift.

Immunity to HA can reduce the likelihood of infection and severity of disease if infection does occur. HA is an important antigenic target and the efficacy of vaccines depends on the antigenic match between the vaccine strain and the circulating strain. Since the hemagglutinin protein readily undergoes antigenic shift and drift in order to evade the host's immune defense, traditional vaccines must be based on currently circulating influenza strains and annually updated. Annual updates of influenza vaccines are not only costly they also require significant amounts of production time and manufacturing infrastructure. A vaccine composition based on invariant regions of the virus may provide broadly cross-reactive protection.

In contrast to the globular head of HA, changes in amino acid residues surrounding the maturational cleavage site of HA are limited due to functional constraints. Amino acid residues surrounding the HA maturational cleavage site influence recognition and therefore cleavability of the site by the host protease. Since the virus does not code for the protease, changes in the amino acid residues surrounding the maturational cleavage site are restricted. As a consequence a peptide of about 20 amino acids spanning the maturational cleavage site remains genetically stable across influenza viruses of the same HA subtype (WO 2004/080403; Bianchi, et al. *J Virol* 79:7380-7388 (2005)) or as branched peptides (Horvath, et al *Immunol Letters* 60:127-136 (1998), Nagy, et al *Scand J Immunol* 40:281-291 (1994)).

A second highly conserved antigen of influenza A is the ectodomain of the matrix 2 protein (M2e). M2 is a 97-amino acid protein expressed at low levels in mature virions and much higher levels on infected cells. The M2 protein forms a homotetramer that functions as an ion channel which is critical to the replication of the virus, thus, mutations in M2e are not as well tolerated as mutations in HA. The 24-amino acid ectodomain (M2e) is highly conserved across multiple influenza A strains. In mammals, M2e is poorly immunogenic in its native form. Antibodies to M2e can confer passive protection in animal models of influenza A infection (Treanor, J. J., et al., *J Virol* 64:1375 (1990); Liu, W. P., et al., *Immunol Lett* 93:131 (2004)), not by neutralizing the virus and preventing infectivity, but by killing infected cells and disrupting the viral life cycle (Zebedee, S. L., et al., *J. Virol.* 62:2762 (1998); Jegerlehner, A. N., et. al., *J Immunol* 172:5598 (2004)), which may be by antibody-dependent NK cell activity (Jegerlehner, A. N., et al., *J Immunol* 172:5598 (2004)). Composition that include M2e proteins may limit the severity of influenza A disease while allowing the host immune response to develop adaptive immunity to the dominant neutralizing influenza antigen, HA.

Strategies to manage infection and illness consequent to influenza viral infection have not changed significantly in the past four decades. Due to the seasonal nature of influenza disease, the distinct types of influenza virus (A and B) that threaten the human population, and the genetic instability of each type, it is necessary to reformulate a multivalent vaccine each year, based on epidemiological prediction of strains likely to be circulating in the human population in the upcoming flu season. The vaccine is produced from stocks of selected prototype viral strains grown in embryonated chicken eggs. Thus, the current strategy has several limitations that include: (a) dependence on uncertain prediction of circulating strains; (b) dependence on the ability to grow the appropriate strains in chicken eggs; (c) the egg-based production system carries risks of product contamination; (d) the product produced in eggs cannot be used in individuals with egg allergies; and (e) a significant risk that the typical multivalent vaccine will not confer protection against a pandemic strain of virus to which the human population has no preexisting immunity.

The dominant protective component of the currently-available influenza vaccine is the viral hemagglutinin (HA). A more effective vaccine may include not only strain-specific HA, but cross-protective antigens, such as M2e and maturational cleavage site. A vaccine production process that is more reliable, economical, and scaleable than the current egg-based method is also preferable. The compositions, fusion proteins and polypeptides of the invention provide compositions that include HA, M2e, and maturational cleavage site of influenza proteins, which can stimulate an immune response, specifically, a protective immune response to several influenza antigens in subject.

The teachings of all patents, published applications and references cited herein are incorporated by reference in their entirety.

EXEMPLIFICATION

Example 1

Design of Portions of a Naturally Occurring Hemagglutinin of Influenza A

Materials and Methods

Design of the HA1-1, 1-2 and 1-3 globular head constructs for A/Puerto Rico/8/34 (H1N1) Influenza strain A/Puerto Rico/8/34 (PR8) is a well-characterized mouse-adapted strain of influenza A virus. The published crystal structure of the mature PR8 HA (SEQ ID NO: 1) (Gamblin et al. 2005. *Science* 303:1838-1842; PDB accession number 1RU7) was used in combination with the Molecular Modeling Database to determine the boundaries for three PR8 globular head constructs. The complete list of solved crystal structures for influenza A hemagglutinin molecules can be found in the Protein Data Bank (PDB) or National Center for Biotechnology Information (NCBI) Structure website.

The three dimensional crystal structure for the PR8 HA was viewed using the Cn3D program within the NCBI website. The trimeric HA molecule has the shape of a mushroom. The globular head refers to the portion of the hemagglutinin molecule at the top that resembles the mushroom head, and the coiled-coil stalk refers to the bottom part of the molecule that resembles the stalk of the mushroom (FIG. 1). The globular head contains the substrate binding site that binds to sialic acid on the cell surface, and therefore is important for viral entry. In addition, the majority of neutralizing antibodies epitopes are located near and around this receptor binding site, making the globular head a good target for protective vaccines. The globular head contains most of the HA1 peptide including residues numbered from E51 to K327 in PR8 for example.

The monomeric structure of PR8 chain A, which encompasses the globular head, was used to guide the design of the PR8 HA1-1, 1-2 and 1-3 constructs (FIG. 1). The HA constructs were designed with domain boundaries within the globular head so that when the molecule is expressed in a host cell, the encoded protein it may spontaneously fold or refolded in vitro to mimic the native conformation. A structural domain (also referred to herein as "domains") within a protein is an element of overall structure that is self-stabilizing and often folds independently of the rest of the protein chain. Most domains can be classified into folds. Many domains are not unique to the proteins produced by one gene or one gene family but instead appear in a variety of proteins. Domains often are named and singled out because they play an important role in the biological function of the protein to which they belong; for example, the substrate binding domain of hemagglutinin can participate in binding to the substrate. Because domains can be self-stabilizing, domains can be swapped between one protein and another or associated to other carrier proteins by genetic engineering to make chimera proteins. A domain may be composed of none, one, or many structural motifs. In the cases of influenza hemagglutinin construct design, many structural motifs are preserved. The boundary selection is guided by known crystal structures. In the case of PR8, residues from E51 to K327 (SEQ ID NO: 1) fold into a compact structure that distinguishes from the rest of the HA molecules, thus is the region of focus to design HA constructs.

Design of the HA-1-1, 1-2 and 1-3 globular head constructs for A/Viet Nam/1203/2004 (H5N1). The HA structure used as a reference in the design of the Viet Nam/1203/2004 (H5N1) globular head constructs is described in Stevens et al, 2006, *Science* 312:404-410 (MMDB number 38730; PDB accession number 2FK0). As described for the PR8 globular head constructs above, the published crystal structure of the mature A/Viet Nam/1203/2004 HA (SEQ ID NO: 2) was used in combination with the Molecular Modeling Database to determine the domain boundaries for three Viet Nam globular head constructs. The same structural criteria for preservation of secondary and tertiary structure for the structural domain were applied to the design of the Viet Nam constructs. While different hemagglutinin molecules can differ in the nature or number of residues that comprise the hemagglutinin molecule; the overall structure is remarkably similar. Thus, design of the domain boundaries for the Viet Nam globular head constructs required placement of the boundaries at structurally equivalent but numerically different positions with in the HA molecule.

Design of the HA1-1, 1-2 and 1-3 lobular head constructs for A/Indonesia/5/2005 (H5N1). The crystal structure for the Indonesia HA has not been solved. In general, when the crystal structure for a given HA molecule has not been solved, the available structure with the highest sequence identity can be used to guide the construct design. In the case of the design of the Indonesia globular head construct, the closest structure available is the A/Viet Nam/1203/2004 (Stevens et al. 2006.

*Science* 312:404-410; MMDB number 38730; PDB Accession number 2FK0), which is of the same subtype as A/Indonesia/5/2005.

To design globular head constructs for this HA, the primary sequence of the Indonesia HA (SEQ ID NO: 3) was first aligned with A/Viet Nam/1203/2004 HA (H5VN; SEQ ID NO: 2) molecule (primary sequence identity: 96.13%). The primary sequence alignment for A/Viet Nam/1203/2004 HA (H5VN; SEQ ID NO: 2) and A/Indonesian/5/2005 (H5IN; SEQ ID NO: 3) was conducted using CLUSTALW and is shown below, where (*) asterisk=identity, (:) colon=conservative substitution; (.) period=weakly conservative substitution; and (space)=divergent substitution.

```
                                                        50
H5IN MEKIVLLLAIVSLVKSDQICIGYHANNSTEQVDTIMEKNVTVTHAQDILE  (SEQ ID NO:
                                                            3)
H5VN MEKIVLLFAIVSLVKSDQICIGYHANNSTEQVDTIMEKNVTVTHAQDILE  (SEQ ID NO:
                                                            2)
     *******:******************************************

                                                       100
H5IN KTHNGKLCDLDGVKPLIILRDCSVAGWLLGNPMCDEFINVPEWSYIVEKAN
H5VN KKHNGKLCDLDGVKPLIILRDCSVAGWLLGNPMCDEFINVPEWSYIVEKAN
     *.************************************************

                                                       150
H5IN PTNDLCYPGSFNDYEELKHLLSRINHFEKIQIIPKSSWSDHEASSGVSSA
H5VN PVNDLCYPGDFNDYEELKHLLSRINHFEKIQIIPKSSWSSHEASLGVSSA
     *.*******.*****************************.**** *****

                                                       200
H5IN CPYLGSPSFFRNVVWLIKKNSTYPTIKKSYNNTNQEDLLVLWGIHHPNDA
H5VN CPYQGKSSFFRNVVWLIKKNSTYPTIKRSYNNTNQEDLLVLWGIHHPNDA
     *** *..********************:**********************

                                                       250
H5IN AEQTRLYQNPTTYISIGTSTLNQRLVPKIATRSKVNGQSGRMEFFWTILK
H5VN AEQTKLYQNPTTYISVGTSTLNQRLVPRIATRSKVNGQSGRMEFFWTILK
     ****:**********:***********:**********************

                                                       300
H5IN PNDAINFESNGNFIAPEYAYKIVKKGDSAIMKSELEYGNCNTKCQTPMGA
H5VN PNDAINFESNGNFIAPEYAYKIVKKGDSTIMKSELEYGNCNTKCQTPMGA
     ****************************:*********************

                                                       350
H5IN INSSMPFHNIHPLTIGECPKYVKSNRLVLATGLRNSPQRESRRKKRGLFG
H5VN INSSMPFHNIHPLTIGECPKYVKSNRLVLATGLRNSPQRERRRKKRGLFG
     **************************************** *********

                                                       400
H5IN AIAGFIEGGWQGMVDGWYGYHHSNEQGSGYAADKESTQKAIDGVTNKVNS
H5VN AIAGFIEGGWQGMVDGWYGYHHSNEQGSGYAADKESTQKAIDGVTNKVNS
     **************************************************

                                                       450
H5IN IIDKMNTQFEAVGREFNNLERRIENLNKKMEDGFLDVWTYNAELLVLMEN
H5VN IIDKMNTQFEAVGREFNNLERRIENLNKKMEDGFLDVWTYNAELLVLMEN
     **************************************************

                                                       500
H5IN ERTLDFHDSNVKNLYDKVRLQLRDNAKELGNGCFEFYHKCDNECMESIRN
H5VN ERTLDFHDSNVKNLYDKVRLQLRDNAKELGNGCFEFYHKCDNECMESVRN
     ***********************************************:**

                                                       550
H5IN GTYNYPQYSEEARLKREEISGVKLESIGTYQILSIYSTVASSLALAIMMA
H5VN GTYDYPQYSEEARLKREEISGVKLESIGIYQILSIYSTVASSLALAIMVA
     ***:************************ *******************:*

                                                       568
H5IN GLSLWMCSNGSLQCRICI
H5VN GLSLWNCSNGSLQCR---
```

Design of the HA1-1, 1-2 and 1-3 globular head constructs for A/New Caledonia/20/1999 (H1N1). The crystal structure for the New Caledonia HA has not been solved. To design the globular head constructs for this HA, the primary sequence of the New Caledonia HA (H1NC; SEQ ID NO: 4) was first aligned with two closely related HA molecules of the same subtype (primary sequence homology >85%) for which the structures have been resolved, specifically the H1N1 1918 virus (same as A/South Carolina/1/18) (SEQ ID NO: 5) and the A/Puerto Rico/8/34 virus (H1PR8; SEQ ID NO: 1) (Gamblin, et al., *Science* 303, 1838-42 (2004). A/South Carolina/1/18: MMDB number 26943, PDB accession number: 1RUZ and PR8, MMDB number: 26941 and PDB accession number: 1RU7). The primary sequence alignment was conducted using CLUSTALW and is shown below, where (*) asterisk=identity, (:) colon=conservative substitution; (.) period=weakly conservative substitution; and (space)=divergent substitution.

```
                                                        50
N1NC    MKAKLLVLLCTFTATYADTICIGYHANNSTDTVDTVLEKNVTVTHSVNLL  (SEQ ID NO: 4)
H1PR8   MKANLLVLLSALAAADADTICIGYHANNSTDTVDTVLEKNVTVTHSVNLL  (SEQ ID NO: 1)
         ***:*****.:::*: **********************************

                                                       100
H1NC    EDSHNGKLCLLKGIAPLQLGNCSVAGWILGNPECELLISKESWSYIVETP
H1PR8   EDSHNGKLCRLKGIAPLQLGKCNIAGWLLGNPECDPLLPVRSWSYIVETP
         ********* **********:*.:***:******: *:. .*********

                                                       150
H1NC    NPENGTCYPGYFADYEELREQLSSVSSFERFEIFPKESSWPNHTVTGVSA
H1PR8   NSENGICYPGDFIDYEELREQLSSVSSFERFEIFPKESSWPNHNTNGVTA
         *.*** **** * ******************************...**:*

                                                       200
H1NC    SCSHNGKSSFYRNLLWLTGKNGLYPNLSKSYVNNKEKEVLVLWGVHHPPN
H1PR8   ACSHEGKSSFYRNLLWLTEKEGSYPKLKNSYVNKKGKEVLVLWGIHHPPN
         :***.************* *:* **:*.:****:* ********:*****

                                                       250
H1NC    IGNQRALYHTENAYVSVVSSHYSRRFTPEIAKRPKVRDQEGRINYYWTLL
H1PR8   SKEQQNIYQNENAYVSVVTSNYNRRFTPEIAERPKVRDQAGRMNYYWTLL
           :*: :*:.********:*:*.********:******* **:*******

                                                       300
H1NC    EPGDTIIFEANGNLIAPWYAFALSRGFGSGIITSNAPMDECDAKCQTPQG
H1PR8   KPGDTIIFEANGNLIAPMYAFALSRGFGSGIITSNASMHECNTKCQTPLG
         :**************** ******************.*.**::***** *

                                                       350
H1NC    AINSSLPFQNVHPVTIGECPKYVRSAKLRMVTGLRNIPSIQSRGLFGAIA
H1PR8   AINSSLPYQNIHPVTIGECPKYVRSAKLRMVTGLRNTPSIQSRGLFGAIA
         *******:**:************************* *************

                                                       400
H1NC    GFIEGGWTGMVDGWYGYHHQNEQGSGYAADQKSTQNAINGITNKVNSVIE
H1PR8   GFIEGGWTGMIDGWYGYHHQNEQGSGYAADQKSTQNAINGITNKVNTVIE
         **********:***********************************:***

                                                       450
H1NC    KMNTQFTAVGKEFNKLERRMENLNKKVDDGFLDIWTYNAELLVLLENERT
H1PR8   KMNIQFTAVGKEFNKLEKRMENLNKKVDDGFLDIWTYNAELLVLLENERT
         *** *************:********************************

                                                       500
H1NC    LDFHDSNVKNLYEKVKSQLKNNAKEIGNGC--------------------
H1PR8   LDFHDSNVKNLYEKVKSQLKNNAKEIGNGCFEFYHKCDNECMESVRNGTY
         ******************************

                                                       550
H1NC    --------------------------------------------------
H1PR8   DYPKYSEESKLNREKVDGVKLESMGIYQILAIYSTVASSLVLLVSLGAIS

                                                       565
H1NC    ---------------
H1PR8   FWMCSNGSLQCRICI
```

Design of the HA1-1, 1-2 and 1-3 globular head constructs for A/Wisconsin/67/2005 (H3N2). The crystal structure for the Wisconsin HA has not been solved. To design the globular head constructs for this HA, the primary sequence of the Wisconsin HA (H3W is; SEQ ID NO: 6) was first aligned with a closely related reference HA molecule of the same subtype (primary sequence identity: 81.16%) for which the structure had been resolved, specifically influenza A/X31 subtype H3N2 (H3X31; SEQ ID NO: 7) (PDB accession number: 1VIU). The Wisconsin HA sequence was aligned with the X31 HA using CLUSTAL W and is shown below, where (*) asterisk=identity, (:) colon=conservative substitution; (.) period=weakly conservative substitution; and (space)=divergent substitution. Each amino acid in X31 was found to have a corresponding match in A/Wisconsin/67/2005 sequence. The domain boundaries the X31 structure were then used to identify the domain boundaries in the A/Wisconsin/67/2005.

```
                                                          50
H3Wis  QKLPGNDNSTATLCLGHHAVPNGTIVKTITNDQIEVTNATELVQSSSTGG  (SEQ ID NO: 6)
H3X31  QDLPGNDNSTATLCLGHHAVPNGTLVKTITDDQIEVTNATELVQSSSTGK  (SEQ ID NO: 7)
       *.**********************:*****:******************

                                                         100
H3Wis  ICDSPHQILDGENCTLIDALLGDPQCDGFQNKKWDLFVERSKAYSNCYPY
H3X31  ICNNPHRILDGIDCTLIDALLGDPHCDVFQNETWDLFVERSKAFSNCYPY
       **:.**:**** :***********:** ***:.**********:******

                                                         150
H3Wis  DVPDYASLRSLVASSGTLEFNDESFNWTGVTQNGTSSACKRRSNNSFFSR
H3X31  DVPDYASLRSLVASSGTLEFITEGFTWTGVIQNGGSNACKRGPGSGFFSR
       ********************  *.*.**** *** *.**** ....****

                                                         200
H3Wis  LNWLTHLKFKYPALNVTMPNNEKFDKLYIWGVHHPGTDNDQIFLHAQASG
H3X31  LNWLTKSGSTYPVLNVTMPNNDNFDKLYIWGIHHPSTNQEQTSLYVQASG
       *****:   .**.********::********:***.*:::*  *:.****

                                                         250
H3Wis  RITVSTKRSQQTVIPNIGSRPRIRNIPSRISIYWTIVKPGDILLINSTGN
H3X31  RVTVSTRRSQQTIIPNIGSRPWVRGLSSRISIYWTIVKPGDVLVINSNGN
       *:****:*****:******** :*.:.**************:*:***.**

                                                         300
H3Wis  LIAPRGYFKIRSGKSSIMRSDAPIGKCNSECITPNGSIPNDKPFQNVNRI
H3X31  LIAPRGYFKMRTGKSSIMRSDAPIDTCISECITPNGSIPNDKPFQNVNKI
       *********:*:************..* ********************:*

                                                         329
H3Wis  TYGACPRYVKQNTLKLATGMRNVPEKQTR
H3X31  TYGACPKYVKQNTLKLATGMRNVPEKQT-
       ******:*********************
```

Results

Depiction of domain boundaries for PR8 HA constructs. The selected boundary domains are highlighted in the sequence below (SEQ ID NO: 1) as follows: HA1-1 boundaries are single-underlined (S53-R324 of SEQ ID NO: 1); HA1-2 boundaries are double-underlined (K62-S284 of SEQ ID NO: 1); HA1-3 boundaries are bold-underlined (N101-G276 of SEQ ID NO: 1). Detailed descriptions of each subunit design and boundary domains are given below.

```
                                                    (SEQ ID NO: 1)
MKANLLVLLSALAAADADTICIGYHANNSTDTVDTVLEKNVTVTHSVNLLEDSHNGKLCR  60

LKGIAPLQLGKCNIAGWLLGNPECDPLLPVRSWSYIVETPNSENGICYPGDFIDYEELRE 120

QLSSVSSFERFEIFPKESSWPNHNTNGVTAACSHEGKSSFYRNLLWLTEKEGSYPKLKNS 180

YVNKKGKEVLVLWGIHHPPNSKEQQNLYQNENAYVSVVTSNYNRRFTPEIAERPKVRDQA 240

GRMNYYWTLLKPGDTIIFEANGNLIAPMYAFALSRGFGSGIITSNASMHECNTKCQTPLG 300

AINSSLPYQNIHPVTIGECPKYVRSAKLRMVTGLRNIPSIQSRGLFGAIAGFIEGGWTGM 360

IDGWYGYHHQNEQGSGYAADQKSTQNAINGITNKVNTVIEKMNIQFTAVGKEFNKLEKRM 420

ENLNKKVDDGFLDIWTYNAELLVLLENERTLDFHDSNVKNLYEKVKSQLKNNAKEIGNGC 480

FEFYHKCDNECMESVRNGTYDYPKYSEESKLNREKVDGVKLESMGIYQILAIYSTVASSL 540

VLLVSLGAISFWMCSNGSLQCRICI                                    565
```

PR/8 HA1-1 construct (SEQ ID NO: 8). For this construct, four (4) conserved disulfide bonds were preserved by making the amino-terminal truncation before the Cysteine at position 59 of SEQ ID NO: 1 and the carboxyl-terminal truncation after the Cysteine at position 319 of SEQ ID NO: 1. The preserved disulfide bonds are listed as the following: C59-C291; C72-C84; C107-C152 and C295-C319 of SEQ ID NO: 1. Using the crystal structure cited above and the Molecular Modeling Database (MMDB) to identify tertiary and secondary structure, the amino terminal truncation was placed at the Serine at position 53 of SEQ ID NO: 1, which is immediately adjacent to the coil turn formed by residues 50-52 of SEQ ID NO: 1 (LED). The truncation completely eliminated the preceding β-strand formed by residues 44-49 of SEQ ID NO: 1 [THSVNL (SEQ ID NO: 214)]. The strand spanning residues 53-58 of SEQ ID NO: 1 [SHNGKL (SEQ ID NO: 215)] and the entire β-strand associated with residues 59-62 of SEQ ID NO: 1 [CRLK (SEQ ID NO: 216)] were preserved. Although in the structure residues 53-58 of SEQ ID NO: 1 [SHNGKL (SEQ ID NO: 215)] are defined as a random coil, these residues mimic a β-strand and thus serve to further stabilize the β-pleated sheets defined by residues 307-310 of SEQ ID NO: 1 [PYQN, SEQ ID NO: 217] and residues 320-323 of SEQ ID NO: 1 [PKYV, SEQ ID NO: 218]. The carboxyl-terminal truncation was made in the random coil sequence spanning residues 324-327 of SEQ ID NO: 1 [RSAK, SEQ ID NO: 219] at the Arginine at position 324 of SEQ ID NO: 1 such that the carboxyl-terminal tail which interacts with HA2 was completely eliminated.

PR/8 HA1-2 construct (SEQ ID NO: 9). For this construct two (2) conserved disulfide bonds (C72-C84 and C107-C152 of SEQ ID NO: 1) were preserved by making the amino-terminal truncation before the Cysteine at position 72 of SEQ ID NO: 1 and the carboxyl-terminal truncation after the Cysteine at position 152 of SEQ ID NO: 1. Using the crystal structure cited above and the MMD database to identify tertiary and secondary structure, the amino-terminal and the carboxyl-terminal truncations were placed in the loops [KGI, residues 62-64 of SEQ ID NO: 1 and NASMHE (SEQ ID NO: 220), residues 285-290, of SEQ ID NO: 1] that connect two distinct sets of β-pleated sheets. Truncation of the molecule within these loops preserves the surrounding secondary structure which in turn preserves the tertiary structure of the globular head.

The amino-terminal truncation was made at the Lysine at position 62 of SEQ ID NO: 1, such that the β-strand comprising APLQLG (SEQ ID NO: 221) at residues 65-70 of SEQ ID NO: 1 of the membrane-distal set of β-strands remained wholly intact, while the preceding β-strand [CRLK, SEQ ID NO: 216, residues 59-62 of SEQ ID NO: 1] that is more membrane-proximal was largely eliminated. The carboxyl-terminal truncation was made at the Serine at position 284 of SEQ ID NO: 1 such that the β-strand [GIITS, SEQ ID NO: 222, residues 280-284 of SEQ ID NO: 1] of the distal set of β-strands remains wholly or largely intact and the subsequent β-strand [CNTK, SEQ ID NO: 223, residues 291-294 of SEQ ID NO: 1] of the proximal set of β-stands is wholly or largely eliminated. Preservation of the distal set of β-strands was the main determinant in selecting the domain boundaries for the HA1-2 construct. The distal β-pleated sheet, which is comprised of β-strands of APLQLG (SEQ ID NO: 221) [residues 65-70 of SEQ ID NO: 1], SYIVET (SEQ ID NO: 224) [residues 94-99 of SEQ ID NO: 1], and GIITS (SEQ ID NO: 222) [residues 280-284 of SEQ ID NO: 1], serves as the stabilizing secondary structural element that ensures a compact domain structure.

PR/8 HA1-3 construct (SEQ ID NO: 10). For this construct one (1) conserved disulfide bond (C107-C152 of SEQ ID NO: 1) was preserved by making the amino-terminal truncation before the Cysteine at position 107 of SEQ ID NO: 1 and the carboxyl terminal truncation after the Cysteine at position 152 of SEQ ID NO: 1. Using the crystal structure cited above and the MMDB database to identify tertiary and secondary structure the amino-terminal truncation was made at the Asparagine at position 101 of SEQ ID NO: 1 such that the preceding α-helix [NIAGWLLG, SEQ ID NO: 225, residues 73-80 of SEQ ID NO: 1] and β-strand [SYIVET, SEQ ID NO: 224, residues 94-99 of SEQ ID NO: 1] were completely eliminated while the subsequent β-stand [PGDFI, SEQ ID NO: 226, residues 109-113 of SEQ ID NO: 1] was preserved along with the strand NSENGICY, SEQ ID NO: 227 [residues 101-108 of SEQ ID NO: 1] that includes the conserved Cysteine at position 107 of SEQ ID NO: 1.

The carboxyl-terminal truncation was made near the end of the β-strand [AFALSRGF, SEQ ID NO: 228, residues 270-277 of SEQ ID NO: 1]. The last amino acid of this strand, position 277 of SEQ ID NO: 1, is a Phenylalanine, which was eliminated so as not to expose this hydrophobic residue. The carboxyl-terminal truncation was made at the Glycine at position 276 of SEQ ID NO: 1 which is in between two secondary structures. Truncation at this position keeps the preceding β-strand [AFALSRG, SEQ ID NO: 229, residues 270-276 of SEQ ID NO: 1] largely intact and completely eliminates the subsequent β-strand [GIITS, SEQ ID NO: 222, residues 280-284 of SEQ ID NO: 1].

Depiction of domain boundaries for VN04 HA construct. The selected boundary domains are highlighted in the sequence below (SEQ ID NO: 2) as follows: HA1-1 boundaries are single-underlined (E50-K323 of SEQ ID NO: 2); HA1-2 boundaries are double-underlined (G62-E284 of SEQ ID NO: 2); HA1-3 boundaries are bold-underlined (N103-G276 of SEQ ID NO: 2). Detailed descriptions of each subunit design and boundary domains are given below.

```
                                                        (SEQ ID NO: 2)
MEKIVLLFAIVSLVKSDQICIGYHANNSTEQVDTIMEKNVTVTHAQDILEKKHNGKLCDL  60

DGVKPLILRDCSVAGWLLGNPMCDEFINVPEWSYIVEKANPVNDLCYPGDFNDYEELKHL 120

LSRINHFEKIQIIPKSSWSSHEASLGVSSACPYQGKSSFFRNVVWLIKKNSTYPTIKRSY 180

NNTNQEDLLVLWGIHHPNDAAEQTKLYQNPTTYISVGTSTLNQRLVPRIATRSKVNGQSG 240

RMEFFWTILKPNDAINFESNGNFIAPEYAYKIVKKGDSTIMKSELEYGNCNTKCQTPMGA 300

INSSMPFHNIHPLTIGECPKYVKSNRLVLATGLRNSPQRERRRKKRGLFGAIAGFIEGGW 360

QGMVDGWYGYHHSNEQGSGYAADKESTQKAIDGVTNKVNSIIDKMNTQFEAVGREFNNLE 420
```

-continued

```
RRIENLNKKMEDGFLDVWTYNAELLVLMENERTLDFHDSNVKNLYDKVRLQLRDNAKELG 480

NGCFEFYHKCDNECMESVRNGTYDYPQYSEEARLKREEISGVKLESIGIYQILSIYSTVA 540

SSLALAIMVAGLSLWMCSNGSLQCR                                    565
```

VN04 HA1-1 construct (SEQ ID NO: 11). For this construct four (4) conserved disulfide bonds were preserved by making the amino terminal truncation before the Cysteine at position 58 of SEQ ID NO: 2 and the carboxyl-terminal truncation after the Cysteine at position 318 of SEQ ID NO: 2. The preserved disulfide bonds are listed as the following: C58-C290; C71-C83; C106-C151 and C294-C318 of SEQ ID NO: 2. Using the crystal structure cited above and the Molecular Modeling Database (MMDB) to identify tertiary and secondary structure, the amino terminal truncation was placed at the Glutamic Acid found at position 50 of SEQ ID NO: 2 such that the preceding β-strand [THAQDI, SEQ ID NO: 230, residues 43-48 of SEQ ID NO: 2] is totally eliminated and the subsequent strand [EKKHNG, SEQ ID NO: 231, residues 50-55 of SEQ ID NO: 2] and the β-strand [KLCDLD, SEQ ID NO: 232] formed by residues 56-61 of SEQ ID NO: 2 were left wholly intact. Structurally the random peptide comprising residues 50-55 of SEQ ID NO: 2 [EKKHNG, SEQ ID NO: 231] mimics a β-strand that completes the membrane-distal β-pleated sheet to keep the domain structure intact. The carboxyl-terminal truncation was made in the loop region near residues 323-326 of SEQ ID NO: 2 [KSNR, SEQ ID NO: 233] that follow the Cysteine at position 318 of SEQ ID NO: 2. Truncation within this loop preserves secondary structure in that the preceding β-strand formed by residues 319-322 of SEQ ID NO: 2 [PKYV, SEQ ID NO: 234] remains wholly intact and the subsequent β-strand [LVLATG, SEQ ID NO: 235, residues 327-332 of SEQ ID NO: 2] is completely eliminated.

VN04 HA1-2 construct (SEQ ID NO: 12). For this construct two (2) conserved disulfide bonds (C71-C83 and C106-C151 of SEQ ID NO: 2) were preserved by making the amino-terminal truncation before the Cysteine at position 71 of SEQ ID NO: 2 and the carboxyl-terminal truncation after the Cysteine at position 151 of SEQ ID NO: 2. Using the crystal structure cited above and the Molecular Modeling Database (MMDB) to identify tertiary and secondary structure, the amino terminal truncation was placed at the glycine at position 62 of SEQ ID NO: 2 such that the subsequent β-strand comprising residues 64-68 of SEQ ID NO: 2 [KPLIL, SEQ ID NO: 236] remains wholly intact, while the preceding β-strand [KLCDLD, SEQ ID NO: 232, residues 56-61 of SEQ ID NO: 2] is completely eliminated.

To preserve secondary structure, the carboxyl-terminal truncation was made in the loop region at the Glutamic Acid at position 284 of SEQ ID NO: 2 such that the preceding β-strand [TIMKS, SEQ ID NO: 237, residues 279-283 of SEQ ID NO: 2] remained wholly or largely intact and the subsequent β-strand [YGNCN, SEQ ID NO: 238, residues 287-291 of SEQ ID NO: 2] was completely eliminated.

VN04 HA1-3 construct (SEQ ID NO: 13). For this construct one (1) conserved disulfide bond (C106-C151 of SEQ ID NO: 2) was preserved by making the amino-terminal truncation before the Cysteine at position 106 of SEQ ID NO: 2 and the carboxyl terminal truncation after the Cysteine at position 151 of SEQ ID NO: 2.

Using the crystal structure cited above and the Molecular Modeling Database (MMDB) to identify tertiary and secondary structure, the amino terminal truncation was placed at the Asparagine at position 103 of SEQ ID NO: 2 such that the preceding β-strand [SYIVEK, SEQ ID NO: 239, residues 93-98 of SEQ ID NO: 2] was completely eliminated while the subsequent β-strand sequence [PGDFN, SEQ ID NO: 240, residues 108-112 of SEQ ID NO: 2] remained wholly or largely intact. To preserve secondary structure, the carboxyl-terminal truncation was made in the random coil region at the Glycine at position 276 of SEQ ID NO: 2 such that the preceding β-strand formed by residues 102-105 of SEQ ID NO: 2 [KGDS, SEQ ID NO: 241] remains wholly or partially intact, the preceding β-strand [EYAYKIVK, SEQ ID NO: 242, residues 267-274 of SEQ ID NO: 2] is wholly preserved and the subsequent β-strand [TIMKS, SEQ ID NO: 237, residues 279-283 of SEQ ID NO: 2] is completely eliminated.

Depiction of domain boundaries for IND05 HA constructs. The A/Indonesia/5/2005 construct description is based on sequence alignment in reference to A/Viet Nam/1203/2004 structure. The selected boundary domains are highlighted in the sequence below (SEQ ID NO: 3) as follows: HA1-1 boundaries are single-underlined (E50-K323, of SEQ ID NO: 3); HA1-2 boundaries are double-underlined (G62-E284 of SEQ ID NO: 3); HA1-3 boundaries are bold-underlined (N103-G276 of SEQ ID NO: 3). Detailed descriptions of each subunit design and boundary domains are given below.

```
                                                                 (SEQ ID NO: 3)
MEKIVLLLAIVSLVKSDQICIGYHANNSTEQVDTIMEKNVTVTHAQDILEKTHNGKLCDL  60

DGVKPLILRDCSVAGWLLGNPMCDEFINVPEWSYIVEKANPTNDLCYPGSFNDYEELKHL 120

LSRINHFEKIQIIPKSSWSDHEASSGVSSACPYLGSPSFFRNVVWLIKKNSTYPTIKKSY 180

NNTNQEDLLVLWGIHHPNDAAEQTRLYQNPTTYISIGTSTLNQRLVPKIATRSKVNGQSG 240

RMEFFWTILKPNDAINFESNGNFIAPEYAYKIVKKGDSAIMKSELEYGNCNTKCQTPMGA 300

INSSMPFHNIHPLTIGECPKYVKSNRLVLATGLRNSPQRESRRKKRGLFGAIAGFIEGGW 360

QGMVDGWYGYHHSNEQGSGYAADKESTQKAIDGVTNKVNSIIDKMNTQFEAVGREFNNLE 420

RRIENLNKKMEDGFLDVWTYNAELLVLMENERTLDFHDSNVKNLYDKVRLQLRDNAKELG 480
```

-continued

```
NGCFEFYHKCDNECMESIRNGTYNYPQYSEEARLKREEISGVKLESIGTYQILSIYSTVA 540

SSLALAIMMAGLSLWMCSNGSLQCRICI                                 560
```

IND05 HA1-1 construct (SEQ ID NO: 14). For this construct four (4) conserved disulfide bonds were preserved by making the amino-terminal truncation before the Cysteine at position 58 of SEQ ID NO: 3 and the carboxyl-terminal truncation after the Cysteine at position 318 of SEQ ID NO: 3. The preserved disulfide bonds are listed as the following: C58-C291; C71-C83; C106-C151 and C294-C318 of SEQ ID NO: 3. Using the crystal structure cited above and the Molecular Modeling Database (MMDB) to identify tertiary and secondary structure, the amino terminal truncation was placed at the Glutamic Acid found at position 50 of SEQ ID NO: 3 such that the preceding β-strand [THAQDI, SEQ ID NO: 243, residues 43-48 of SEQ ID NO: 3] was totally eliminated and the subsequent strand [EKTHNG, SEQ ID NO: 244, residues 50-55 of SEQ ID NO: 3] and β-strand [KLCDLD, SEQ ID NO: 245] formed by residues 56-61 of SEQ ID NO: 3 was left wholly intact. Structurally the random peptide comprising residues 50-55 of SEQ ID NO: 3 [EKTHNG, SEQ ID NO: 244] mimics a β-strand that completes the membrane-distal β-pleated sheet to keep the domain structure intact. The carboxyl-terminal truncation was made in the loop region near residues 323-326 of SEQ ID NO: 3 [KSNR, SEQ ID NO: 246] that follow the Cysteine at position 318 of SEQ ID NO: 3. Truncation within this loop preserves secondary structure in that the preceding β-strand formed by residues 319-322 of SEQ ID NO: 3 [PKYV, SEQ ID NO: 247] remains wholly intact and the subsequent β-strand [LVLATG, SEQ ID NO: 248, residues 327-332 of SEQ ID NO: 3] is completely eliminated.

IND05 HA1-2 construct (SEQ ID NO: 15). For this construct two (2) conserved disulfide bonds (C71-C83 and C106-C151 of SEQ ID NO: 3 were preserved by making the amino-terminal truncation before the Cysteine at position 71 of SEQ ID NO: 3 and the carboxyl-terminal truncation after the Cysteine at position 151 of SEQ ID NO: 3. Using the crystal structure cited above and the Molecular Modeling Database (MMDB) to identify tertiary and secondary structure, the amino terminal truncation was placed at the Glycine at position 62 of SEQ ID NO: 3 such that the subsequent β-strand comprising residues 64-68 of SEQ ID NO: 3 [KPLIL, SEQ ID NO: 249] remained wholly intact, while the preceding β-strand [KLCDLD, SEQ ID NO: 245, residues 56-61 of SEQ ID NO: 3] was completely eliminated. To preserve secondary structure, the carboxyl terminal truncation was made in the loop region at the Glutamic Acid at position 284 of SEQ ID NO: 3 in the sequence [ELE, residues 284-286 of SEQ ID NO: 3] such that the preceding β-strand [AIMKS, SEQ ID NO: 250, residues 279-283 of SEQ ID NO: 3] remained wholly or largely intact and the subsequent β-strand [YGNCN, SEQ ID NO: 251, residues 287-291 of SEQ ID NO: 3] was completely eliminated.

IND05 HA1-3 construct (SEQ ID NO: 16). For this construct one (1) conserved disulfide bond (C106-C151 of SEQ ID NO: 3 was preserved by making the amino-terminal truncation before the Cysteine at position 106 of SEQ ID NO: 3 and the carboxyl-terminal truncation after the Cysteine at position 151 of SEQ ID NO: 3. Using the crystal structure cited above and the Molecular Modeling Database (MMDB) to identify tertiary and secondary structure, the amino terminal truncation was placed at the asparagine at position 103 of SEQ ID NO: 3 such that the preceding β-strand [SYIVEK, SEQ ID NO: 252, residues 93-98 of SEQ ID NO: 3] was completely eliminated while the β-strand sequence [PGSFN, SEQ ID NO: 253, residues 108-112 of SEQ ID NO: 3] remained wholly or largely intact. To preserve secondary structure, the carboxyl-terminal truncation was made in the random coil region at the Glycine found at position 276 of SEQ ID NO: 3 such that the preceding β-strand [EYAYKIVK, SEQ ID NO: 254, residues 267-274 of SEQ ID NO: 3] was wholly preserved and the subsequent β-strand [AIMKS, SEQ ID NO: 250, residues 279-283 of SEQ ID NO: 3] was completely eliminated.

Depiction of domain boundaries for New Caledonia HA constructs. A/New Caledonia/20/199 construct description is based on sequence alignment in reference of A/Puerto Rico/8/34 structure. The selected boundary domains are highlighted in the sequence below (SEQ ID NO: 4) as follows: HA1-1 boundaries are single-underlined (S53-R324 of SEQ ID NO: 4); HA1-2 boundaries are double-underlined (K62-S284 of SEQ ID NO: 4); HA1-3 boundaries are bold-underlined (N101-G276 of SEQ ID NO: 4). Detailed descriptions of each subunit design and boundary domains are given below.

```
                                                    (SEQ ID NO: 4)
MKAKLLVLLCTFTATYADTICIGYHANNSTDTVDTVLEKNVTVTHSVNLLEDSHNGKLCL  60

LKGIAPLQLGNCSVAGWILGNPECELLISKESWSYIVETPNPENGTCYPGYFADYEELRE 120

QLSSVSSFERFEIFPKESSWPNHTVTGVSASCSHNGKSSFYRNLLWLTGKNGLYPNLSKS 180

YVNNKEKEVLVLWGVHHPPNIGNQRALYHTENAYVSVVSSHYSRRFTPEIAKRPKVRDQE 240

GRINYYWTLLEPGDTIIFEANGNLIAPWYAFALSRGFGSGIITSNAPMDECDAKCQTPQG 300

AINSSLPFQNVHPVTIGECPKYVRSAKLRMVTGLRNIPSIQSRGLFGAIAGFIEGGWTGM 360

VDGWYGYHHQNEQGSGYAADQKSTQNAINGITNKVNSVIEKMNTQFTAVGKEFNKLERRM 420

ENLNKKVDDGFLDIWTYNAELLVLLENERTLDFHDSNVKNLYEKVKSQLKNNAKEIGNGC 480

FEFYHKCNNECMESVKNGTYDYPKYSEESKLNREKIDGVKLESMGVYQILAIYSTVASSL 540

VLLVSLGAISFWMCSNGSLQCRICI                                    565
```

New Caledonia HA1-1 construct design (SEQ ID NO: 17). For this construct, four (4) conserved disulfide bonds were preserved by making the amino terminal truncation before the Cysteine at position 59 of SEQ ID NO: 4 and the carboxyl-terminal truncation after the Cysteine at position 319 of SEQ ID NO: 4. The preserved disulfide bonds are listed as the following: C59-C291; C72-C84; C107-C152 and C295-C319 of SEQ ID NO: 4. Using the reference crystal structures and the MMDB to check secondary structures the amino terminal truncation was made at the Serine at position 53 of SEQ ID NO: 4 such that the preceding β-strand [THSVNLLED, SEQ ID NO: 255, residues 44-52 of SEQ ID NO: 4] was totally eliminated and the subsequent β-strands SHNGKL, SEQ ID NO: 256 [residues 53-58 of SEQ ID NO: 4] and APLQLG, SEQ ID NO: 257 [residues 65-70, of SEQ ID NO: 4] were left wholly intact. The amino-terminal truncation in the random coil sequence [SHNGKL, SEQ ID NO: 256, residues 53-58 of SEQ ID NO: 4] left the secondary structure largely intact because it mimics a β-strand that leaves the β-pleated sheet intact. The carboxyl-terminal truncation was made at the Arginine at position 324 of SEQ ID NO: 4 in the random coil sequence [RSAK, SEQ ID NO: 258, residues 324-327 of SEQ ID NO: 4] following the Cysteine at position 319 of SEQ ID NO: 4. The truncation in this random coil preserves secondary structure by leaving the preceding β-strand [PKYV, SEQ ID NO: 259, residues 320-323 of SEQ ID NO: 4] wholly intact while the subsequent β-strand [LRMVTG, SEQ ID NO: 260, residues 328-333 of SEQ ID NO: 4] is completely eliminated.

New Caledonia HA1-2 construct design (SEQ ID NO: 18). For this construct two (2) conserved disulfide bonds (C72-C84 and C107-C152 of SEQ ID NO: 4) were preserved by making the amino-terminal truncation before the Cysteine at position 72 of SEQ ID NO: 4 and the carboxyl-terminal truncation after the Cysteine at position 152 of SEQ ID NO: 4. Using the reference crystal structures and the MMDB to check secondary structures the amino-terminal truncation was made at the Lysine at position 62 of SEQ ID NO: 4 such that the random coil sequence comprising [SHNGKLCLLKGI, SEQ ID NO: 261, residues 53-64 of SEQ ID NO: 4] was partially or largely removed, the preceding β-strand [THSVNLLED, SEQ ID NO: 255, residues 44-52 of SEQ ID NO: 4] was completely eliminated and the subsequent β-strand [APLQLG, SEQ ID NO: 257, residues 65-70 of SEQ ID NO: 4] remained wholly intact. The carboxyl-terminal truncation was made at the Serine at position 284 of SEQ ID NO: 4 such that the preceding β-strand [SGIITS, SEQ ID NO: 262, residues 279-284 of SEQ ID NO: 4] remained wholly intact and the subsequent random coil [NAPMDECDA, SEQ ID NO: 263, residues 285-293 of SEQ ID NO: 4] was wholly or largely eliminated.

New Caledonia HA1-3 construct design (SEQ ID NO: 19). For this construct one (1) conserved disulfide bond (C107-C152 of SEQ ID NO: 4 was preserved by making the amino-terminal truncation before the Cysteine at position 107 of SEQ ID NO: 4 and the carboxyl terminal truncation after C152 of SEQ ID NO: 4. Using the reference crystal structures and the MMDB to check secondary structures the amino-terminal truncation was made at the Asparagine at position 101 of SEQ ID NO: 4 such that the receding β-strand [SYIVET, SEQ ID NO: 264, residues 94-99 of SEQ ID NO: 4] was completely eliminated and the subsequent β-strand [PGYFA, SEQ ID NO: 265, residues 109-113 of SEQ ID NO: 4] remained wholly intact. To preserve the secondary structure the carboxyl-terminal truncation was made at the Glycine at position 276 of SEQ ID NO: 4 such that the β-strand sequence [YAFALSRGF, SEQ ID NO: 266, residues 269-277 of SEQ ID NO: 4] remained largely intact, while the subsequent β-strand sequence [SGIITS, SEQ ID NO: 262, residues 279-284 of SEQ ID NO: 4] was eliminated.

Depiction of domain boundaries for A/Wisconsin/67/2005 HA constructs. A/Wisconsin/67/2005 construct description is based on sequence alignment in reference of A/X31 structure. The selected boundary domains are highlighted in the sequence below (SEQ ID NO: 6) as follows: HA1-1 boundaries are single-underlined (Q44-K310 of SEQ ID NO: 6); HA1-2 boundaries are double-underlined (S54-D271 of SEQ ID NO: 6); HA1-3 boundaries are bold-underlined (S95-G263 of SEQ ID NO: 6). Detailed descriptions of each subunit design and boundary domains are given below.

```
                                                    (SEQ ID NO: 6)
QKLPGNDNSTATLCLGHHAVPNGTIVKTITNDQIEVTNATELVQSSSTGGICDSPHQILD  60

GENCTLIDALLGDPQCDGFQNKKWDLFVERSKAYSNCYPYDVPDYASLRSLVASSGTLEF 120

NDESFNWTGVTQNGTSSACKRRSNNSFFSRLNWLTHLKFKYPALNVTMPNNEKFDKLYIW 180

GVHHPGTDNDQIFLHAQASGRITVSTKRSQQTVIPNIGSRPRIRNIPSRISIYWTIVKPG 240

DILLINSTGNLIAPRGYFKIRSGKSSIMRSDAPIGKCNSECITPNGSIPNDKPFQNVNRI 300

TYGACPRYVKQNTLKLATGMRNVPEKQTR                                329
```

A/Wisconsin/67/2005 HA1-1 construct design (SEQ ID NO: 20). For this construct, four (4) conserved disulfide bonds were preserved by making the amino terminal truncation before the Cysteine at position 52 of SEQ ID NO: 6 and the carboxyl-terminal truncation after the Cysteine at position 305 of SEQ ID NO: 6. The preserved disulfide bonds are listed as the following: C52-C277; C64-C76; C97-C139 and C281-C305 of SEQ ID NO: 6. Using the reference crystal structures and the MMDB to check secondary structures the amino terminal truncation was made at the Glutamine at position 44 of SEQ ID NO: 6, right after the tight turn formed by residues 42 and 43 of SEQ ID NO: 6 [LV], such that the preceding β-strand [TNATE, SEQ ID NO: 267, residues 37-41 of SEQ ID NO: 6] was totally eliminated while the entire short β-strand formed by residues QSS [44-46 of SEQ ID NO: 6] was preserved. The carboxyl-terminal truncation was made in the random coil sequence [PRYVK, SEQ ID NO: 268, residues 306-310 of SEQ ID NO: 6] following the Cysteine at position 305 of SEQ ID NO: 6 such that the carboxyl-terminal tail which interacts with HA2 was completely eliminated. Although the carboxyl-terminal sequence [PRYVK, SEQ ID NO:268, residues 306-310 of SEQ ID NO: 6)] is defined as a random coil, structurally it serves as an additional β-strand that further stabilizes the β-pleated sheets defined by residues 44-46 of SEQ ID NO: 6 [QSS] and residues 293-297 of SEQ ID NO: 6 [PFQNV, SEQ ID NO: 269]. This set of β-pleated encompasses the amino-terminus and carboxy-terminus within one stable secondary structure element to ensure a compact domain structure.

A/Wisconsin/67/2005 HA1-2 construct design (SEQ ID NO: 21). For this construct two (2) conserved disulfide bonds (C64-C76 and C97-C139 of SEQ ID NO: 6) were preserved by making the amino-terminal truncation before the Cysteine at position 64 of SEQ ID NO: 6 and the carboxyl-terminal truncation after the Cysteine at position 139 of SEQ ID NO: 6. Using the reference crystal structures and the MMDB to check secondary structures the amino-terminal truncation was made in the loops that connect two distinct sets of β-pleated sheets. The amino-terminal truncation was made at the Serine at position 54 of SEQ ID NO: 6, such that the β-strand comprising residues 57-62 of SEQ ID NO: 6 [QILDGE, SEQ ID NO: 270] of the membrane-distal set of β-strands remained wholly intact, while the membrane-proximal β-strand [GGICD, SEQ ID NO: 271, residues 49-53 of SEQ ID NO: 6] was completely eliminated. The carboxyl-terminal truncation was made at the Aspartic Acid at position 271 of SEQ ID NO: 6. Truncation at this position preserved secondary structure such that the membrane-distal β-strand [SSIMRS, SEQ ID NO: 272, residues 265-270 of SEQ ID NO: 6] remained intact while the membrane-proximal β-strand [APIGK, SEQ ID NO: 273, residues 272-276 of SEQ ID NO: 6] was eliminated. The membrane-distal β-pleated sheets comprising 1-strands QILDGE (SEQ ID NO: 270), [residues 57-62 of SEQ ID NO: 6] LFVER (SEQ ID NO: 274) [residues 86-90 of SEQ ID NO: 6], and SSIMRS, (SEQ ID. NO: 272), [residues 265-270 of SEQ ID NO: 6] serve as the stabilizing secondary structure element that ensures a compact domain structure.

A/Wisconsin/67/2005 HA1-3 construct design (SEQ ID NO: 22). For this construct one (1) conserved disulfide bond (C97-C139 of SEQ ID NO: 6) was preserved by making the amino-terminal truncation before the Cysteine at position 97 of SEQ ID NO: 6 and the carboxy-terminal truncation after the Cysteine at position 139 of SEQ ID NO: 6. Using the reference crystal structure and the MMDB to check secondary structures the amino-terminal truncation was made at the Serine at position 95 of SEQ ID NO: 6 such that the preceding α-helix [TLIDALLG, SEQ ID NO: 275, residues 65-72 of SEQ ID NO: 6] was completely eliminated while the Serine at position 95 of SEQ ID NO: 6 and Asparagine at position 96 of SEQ ID NO: 6 were preserved along with the conserved Cysteine at position 97 of SEQ ID NO: 6. The carboxyl-terminal truncation was made in the random coil sequence at about the Glycine at position 263 of SEQ ID NO: 6 such that the random coil sequence containing residues 261-263 of SEQ ID NO: 6 [RSG] was kept wholly or partially intact, while the preceding β-strand [RGYFKI, SEQ ID NO: 276, residues 255-260 of SEQ ID NO: 6] was wholly preserved and the subsequent β-strand [SSIMRS, SEQ ID NO: 272, residues 265-270 of SEQ ID NO: 6] was completely eliminated.

Discussion

Parts of the globular head domain of the influenza virus hemagglutinin (HA) protein may generate neutralizing antibodies (Brand and Skehel, 1972; Eckert, 1973; Jackson et al., 1979; Russ et al., 1981) and the discrete, globular structure of this domain was thought to constitute a protein fragment which could be expressed in bacteria and refolded, or expressed and secreted from a eukaryotic host, thereby avoiding the expression and purification problems which have been encountered producing the full-length HA protein.

The largest HA construct (also referred to herein as "HA fragment") fused to STF2, HA1-1 (SEQ ID NO: 8, 11, 14, 17, 20), encompasses most of or likely the entire globular region of the naturally occurring (wild type) HA1 head domain. A naturally occurring fragment of HA1 very similar to the HA1-1 construct is released from the virus on limited proteolysis (Bizeband et al., 1995). Thus, structural analysis and experimental data suggest that the HA 1-1 construct should fold efficiently, whether produced in bacteria or eukaryotes, and maintain a stable native-like structure. Similarly, it is expected that the entire HA0s, the external portion of HA molecule outside the viral membrane (SEQ ID NO: 23) consisting of HA1 and HA2 but excluding the signal peptide (17 aa), internal peptide within the viral membrane (12 aa) and transmembrane domain (24 aa) should attain its native conformation when expressed in a eukaryotic host or can be refolded into a native state in vitro when expressed in bacteria. The two smaller HA fragments (HA1-2 (SEQ ID NO: 9, 12, 15, 18, 21) and HA1-3 (SEQ ID NO: 10, 13, 16, 19, 22)) truncate the region of the head domain distal to the receptor binding site in a manner which may either destabilize the resulting protein fragment (HA1-3) or expose the side chains of a few large hydrophobic residues (HA1-2). For this reason, experimental mutations were introduced into the HA1-2 and HA1-3 constructs, denoted as HA1-2mut (SEQ ID NO: 24, 26, 28, 30, 32) and HA1-3mut (SEQ ID NO: 25, 27, 29, 31, 33). The substitutions made in the HA1-3mut (SEQ ID NO: 25, 27, 29, 31, 33) construct introduce oppositely charged residues on the opposite strands which are left exposed by the HA1-3 truncations. "HA mut," as used herein, means an amino acid in the native or naturally occurring HA has been substituted with an amino acid that does not occur in the native or naturally occurring HA. Substituted residues may form a salt bridge and stabilize a structure which may otherwise fold poorly, or not at all. For example, in PR8, G105 was replaced by glutamate and Y115 was substituted with lysine (SEQ ID NO: 25). Negatively charged glutamate interacted with positively charged lysine residue so that N-terminal peptide 1-8 of SEQ ID NO: 25 [NSENEICY, SEQ ID NO: 277] was stabilized by charge-charge interaction with Lysine 15 located at the N-terminus of the short helix 15-22 of SEQ ID NO: 25 [KEELREQL, SEQ ID NO: 278] in the center of the molecule. For the HA1-2 construct, the truncations can lead to the exposure of hydrophobic side chains which would not be expected to impair expression of the protein. However, the exposed residues may lead to aggregation of expressed protein or instability of expressed protein. To avoid aggregation and enhance the stability of the expressed molecule the few large hydrophobic residues that become exposed were substituted with more neutral amino acids to generate HA1-2mut (SEQ ID NO: 24, 26, 28, 30, 32). These substitutions may result in a protein which is more amenable to a robust manufacturing process and/or long term stability.

Example 2

Design of Portions of a Naturally Occurring Hemagglutinin of Influenza B

Materials and Methods

Design of the HA1-1, 1-2 and 1-3 globular head constructs for B/Lee/40. Structural considerations in the design of an influenza B HA vaccine are similar to those for influenza A, i.e., the domain boundary of the globular head of HA must be identified so that the flagellin-HA fusion protein can fold correctly or be refolded correctly to expose appropriate antigenic epitopes. Unlike influenza A, well-defined X-ray crystallographic structures are not available for influenza B HA, thus it is more difficult to unambiguously define the domain boundary of globular head. Therefore the influenza B HA model must be predicted based on bioinformatic and structural models (Tung et al. 2004. *J. Gen. Virl.* 85, 3249-3259). These investigators used a "knowledge-based" approach which depends on a high degree of sequence homology between the known structure from the protein data bank and the target unknown structure. In general, this approach benefits most from at least 35% sequence identity between the known and target proteins.

In the case of influenza B, the closest models come from A/Swine/Hong Kong/9/98 (SEQ ID NO: 34) (24% identity, PDB accession code 1JSD) and A/Aichi/2/68 (SEQ ID NO: 35) (21% identity, PDB accession code 1HGF). Although the sequence identities between the target model B/Lee/40 HA (SEQ ID NO: 36) and known template models are substantially below the desired minimum of 35%, the close similarity of the functions and tertiary folds of influenza A HA proteins in spite of their sequence divergence (H1, H3, H5 and H9 share only 18% sequence identity) suggest a possibly successful prediction of influenza B HA structure using the influenza A HA model. Moreover, influenza C HEF (Hemagglutinin-Esterase-Fusion) protein folds similarly to influenza A HA structure despite even lower sequence identity than any of the A/B comparison.

Since the crystal structure of influenza C HEF is known (PDB accession-number 1FLC, MMDB accession number 12663), Tung et al included the knowledge of the structure similarity between C HEF and the known influenza A HA proteins to predict influenza B HA structure. Tung et al first aligned the HEF sequence from C/Johannesburg/1/66 (SEQ ID NO: 37) with one sequence from each of the 15 HA subtypes of influenza A virus (http://flu.lanl.gov) using CLUSTALW (Thompson et al. 1994. *Nucleic Acids Res* 22, 4673-4680) and compiled a profile based on structure-informed alignment.

The conserved secondary structural features were captured and assigned, as well as the variations among the types and subtypes by year and host species. They then further aligned the augmented A/C profile to an alignment of influenza B HA sequences, including B/Lee/40. The homology modeling techniques of Tung (1999) was used to construct B/Lee/40 model.

Briefly, they first matched the main-chain structures of the target to those of the template in the aligned regions. Insertions in the target relative to the template were treated as loops with known end-structure. Stretching the predicted structure accommodated insertions in the template relative to the target. The mainchain structures of the loops were modeled by using an efficient Monte Carlo loop-sampling method (Tung, 1997; Ryu et al., 1998). Once the main-chain structure was modeled, the side-chain atoms were attached. As the head of the HA molecule is compact, limited space is available to place the side-chain atoms. Hence, in the analysis, side-chain torsional angles were initialized to equal or be close to those in the template structure. This consideration is particularly useful in avoiding clashes between side chains in the modeled structure. Finally, the all-atom models were subjected to a short run of energy minimization (1000 cycles) by using AMBER (Weiner et al., 1986) to relieve unfavourable steric interactions and to optimize the stereochemistry. The quality of the target model was checked by PROCHECK (Wilson et al. 1998. *J Mol. Biol.* 276, 417-436) and the functionality was checked by substrate docking to test whether the model substrate binding site can accommodate the natural receptor analogue sialyllactose as we have seen in the crystal structure of the HA of A/Aichi/2/68 (Weis et al. 1988. *Nature* 333, 426-431). The simulated B/Lee/40 model appears reasonable in a Ramachandran Plot (Wilson et al. 1998. *J Mol. Biol.* 276, 417-436) and shows no steric crash when docking the sialyl-2-3-lactose molecule into the substrate binding site of the B/Lee/40 model, indicating a correct stereochemistry. Therefore the B/Lee/40 model was used to guide the design of influenza B HA subunit vaccines.

Results and Discussion

Depiction of Domain Boundaries for B/Lee/40 HA constructs. The selected boundary domains are highlighted in the sequence below as follows: HA1-1 boundaries are single-underlined (T48-K340 of SEQ ID: 36), and HA1-2 boundaries are double-underlined (K60-G299 of SEQ ID: 36). Detailed descriptions of each subunit design and boundary domains are given below.

```
                                                            (SEQ ID NO: 36)
MKAIIVLLMVVTSNADRICTGITSSNSPHVVKTATQGEVNVTGVIPLTTTPTKSHFANLK  60

GTQTRGKLCPNCFNCTDLDVALGRPKCMGNTPSAKVSILHEVKPATSGCFPIMHDRTKIR 120

QLPNLLRGYENIRLSTSNVINTETAPGGPYKVGTSGSCPNVANGNGFFNTMAWVIPKDNN 180

KTAINPVTVEVPYICSEGEDQITVWGFHSDDKTQMERLYGDSNPQKFTSSANGVTTHYVS 240

QIGGFPNQTEDEGLKQSGRIVVDYMVQKPGKTGTIVYQRGILLPQKVWCASGRSKVIKGS 300

LPLIGEADCLHEKYGGLNKSKPYYTGEHAKAIGNCPIWVKTPLKLANGTKYRPPAKLLKE 360

RGFFGAIAGFLEGGWEGMIAGWHGYTSHGAHGVAVAADLKSTQEAINKITKNLNYLSELE 420

VKNLQRLSGAMNELHDEILELDEKVDDLRADTISSQIELAVLLSNEGIINSEDEHLLALE 480

RKLKKMLGPSAVEIGNGCFETKHKCNQTCLDRIAAGTFNAGDFSLPTFDSLNITAASLND 540

DGLDNHTILLYYSTAASSLAVTLMIAIFIVYMVSRDNVSCSICL                 584
```

The coordinates of the simulated B/Lee/40 model are available in Protein Data Bank with the accession code 1TX1. The pdb file was converted to the MMDB (Molecular Modeling Data Base) format by using VAST (Vector Alignment Search Tool) search. The model of 1TX1 structure then was viewed by Cn3D and the structure was saved in MMDB format. Based on the same principal used to design influenza A HA1-1 and HA1-2 constructs, the domain boundaries of B/Lee/40 HA-1 and HA 1-2 were pinpointed by examining the model structure. B/Lee/40 HA1-1 (SEQ ID NO: 38) includes the epitope-concentrated globular top, the membrane distal β-sheet and an additional β-sandwich located underneath the membrane distal β-sheet. The amino terminus of HA1-1 starts from residue 48 and ends at residue 340 (TTTPTK (SEQ ID NO: 279) . . . - . . . CPIWVK (SEQ ID NO: 280)) of SEQ ID NO: 36). The B/Lee/40 HA1-2 (SEQ ID NO: 39) was designed by removing the β-sandwich from HA1-1. HA1-2 starts from residue 60 and ends at residue 299 (KGTQTR (SEQ ID NO: 281) . . . - . . . . SKVIKG (SEQ ID NO: 282)) of SEQ ID NO: 36. In order to confirm the boundary selection, other independent methods were also employed. The first method used was the primary sequence alignment. The sequence of A/Aichi/2/68 (SEQ ID NO: 35) was aligned with B/Lee/40 (SEQ ID NO: 36) sequence. The boundaries of A/Aichi/2/68 HA1-1 (SEQ ID NO: 40) (residues 60-326 QSSSTG (SEQ ID NO: 283) . . . - . . . CPKYVK (SEQ ID NO: 284)) and HA1-2 (SEQ ID NO: 41) (residues 72-287; HRILDG (SEQ ID NO: 285) . . . - . . . SIMRSD (SEQ ID NO: 286)) were aligned closely to those of B/Lee/40, supporting the boundary selections using simulated model. One residue adjustment was made to avoid exposing hydrophobic residues and either end of the construct. Thus, the 3-dimensional structure prediction matches very well with primary sequence alignment.

The second method used was the secondary structure prediction. The domain boundary is usually located in the loop or turn region without invading much of the secondary structure elements such as the α-helix and the β-sheet, especially the center of the α-helix bundle or the β-sheet. This criterion was used to double check if the boundary selection made form simulated 3-D structure is in agreement with independent secondary structure prediction. The program PHD (http://ca.expasy.org/tools→Proteomics and sequence analysis tools→Secondary and tertiary structure tools→PredictProtein) was used to perform the secondary structure prediction. Other than two of the HA1-2 carboxy-terminal residues overlapping with a short α-helix (5 amino acids), all other boundary residues fall in the loop regions, indicating a reasonable boundary selection. PHD results is listed as the following, where AA is the amino acid sequence; OBS_sec is the observed secondary structure: H=helix, E=extended sheet, blank=other (loop); PROF_sec: PROF predicted secondary structure: H=helix, E=extended (sheet), blank=other (loop), PROF=PROF: Profile network prediction HeiDelberg; Rel_sec: reliability index for PROFsec prediction (0=low to 9=high)

For the brief presentation strong predictions marked by '*'; SUB_sec: subset of the PROFsec prediction, for all residues with an expected average accuracy >82% NOTE: for this subset the following symbols are used: L: is loop (for which above " is used): means that no prediction is made for this residue, as the reliability is: Rel<5; O_3_acc: observed relative solvent accessibility (acc) in 3 states: b=0-9%, i=9-36%, e=36-100%; P_3_acc: PROF predicted relative solvent accessibility (acc) in 3 states: b=0-9%, i=9-36%, e=36-100%; Rel_acc: reliability index for PROFacc prediction (0=low to 9=high).

For the brief presentation strong predictions marked by '*'; SUB_acc: subset of the PROFacc prediction, for all residues with an expected average correlation >0.69 (tables in header).

NOTE: for this subset the following symbols are used:

I: is intermediate (for which above " is used)

.:means that no prediction is made for this residue, as the reliability is:

```
           ....,....1....,....2....,....3....,....4....,....5
AA         MKAIIVLLMVVTSNADRICTGITSSNSPHVVKTATQGEVNVTGVIPLTTT
OBS_sec
PROF_sec   EEEEEEEEEE     EEEEEEEE     EEEEEE    EEEEEEEEEE
Rel_sec    90456542111257762677454037753444441276147765653203
SUB_sec    L..EEE......LLLL.EEE.E...LLL........LL..EEEEEE....

O_3_acc    bbbbbbbbbbbbbbbbbbbbbbbbbbbbbbbbbbbbbbbbbbbbbbbbbb
P_3_acc    ee bbbbbbbbbeeb  bbbbbbb eeee b bb eeebeb  b  bbe
Rel_acc    33169997521111032778921201222233322135234021321012
SUB_acc    ...BBBBBB........BBBB................E..B.........

           ....,....6....,....7....,....8....,....9....,....10
AA         PTKSHFANLKGTQTRGKLCPNCFNCTDLDVALGRPKCMGNTPSAKVSILH
OBS_sec
PROF_sec   EEEE                  EEEEEE              EEEE
Rel_sec    67752200245344675222033211232342043234337875203787
SUB_sec    LLLL......L...LLL.......................LLLL...EEE

O_3_acc    bbbbbbbbbbbbbbbbbbbbbbbbbbbbbbbbbbbbbbbbbbbbbbbbbb
P_3_acc    eee  bbe eeeeeee    eb  bbbbbbbbb b b ee eeeeb bbb
Rel_acc    23201011020002300210201031223343310100210221541265
SUB_acc    ..............................b.............eb..bb

           ....,....11.1.,....12.1.,....13.1.,....14.1.,....15.1
AA         EVKPATSGCFPIMHDRTKIRQLPNLLRGYENIRLSTSNVINTETAPGGPY
OBS_sec
PROF_sec   EE             HHHHHHHHHHH     EEEEE  EE
Rel_sec    50566441224778858887664221002304663021003444556531
SUB_sec    E.LLL......LLLLHHHHHHH..........EE..........LLLL..

O_3_acc    bbbbbbbbbbbbbbbbbbbbbbbbbbbbbbbbbbbbbbbbbbbbbbbbbb
P_3_acc    b  eeee bbbbb   e b ebbebbee eeb         eeeeee
Rel_acc    12210110221001337264350314531332301200011120132011
SUB_acc    ................e.bi.b...be.......................
```

-continued

```
            ....,....16.1.,....17.1.,....18.1.,....19.1.,....20.1
AA          KVGTSGSCPNVANGNGFFNTMAWVIPKDNNKTAINPVTVEVPYICSEGED
OBS_sec
PROF_sec    HHHHHHHHHHH            EEEEEE
Rel_sec     24431001255662036787888752378864236641012244157874
SUB_sec     .........LLLL...HHHHHHHHH..LLLL...LL.........LLLL.

O_3_acc     bbbbbbbbbbbbbbbbbbbbbbbbbbbbbbbbbbbbbbbbbbbbbbbbbb
P_3_acc     bbbbbbee ee bbbbbbb  bbeeeee    ee ebeb b b eee
Rel_acc     11111012110301026314921522122321112112322203203212
SUB_acc     ................b..bb..b..........................

            ....,....21.1.,....22.1.,....23.1.,....24.1.,....25.1
AA          QITVWGFHSDDKTQMERLYGDSNPQKFTSSANGVTTHYVSQIGGFPNQTE
OBS_sec
PROF_sec    EEEEEEEE     HHHHHH      EEEEE  EEEEEEEE
Rel_sec     47897532588742544320368853775200122343201275331035
SUB_sec     .EEEEE..LLLL..H......LLLL.EEE.............LL.....L

O_3_acc     bbbbbbbbbbbbbbbbbbbbbbbbbbbbbbbbbbbbbbbbbbbbbbbbbb
P_3_acc     bbbbbbbbb eeee    b eeeeeeb b b e e e   ebee b   e
Rel_acc     19696993033223122210203213224011122211311001202001
SUB_acc     .bbbbbb.....................b.....................

            ....,....26.1.,....27.1.,....28.1.,....29.1.,....30.1
AA          DEGLKQSGRIVVDYMVQKPGKTGTIVYQRGILLPQKVWCASGRSKVIKGS
OBS_sec
PROF_sec    EEEEEEEEE    EEEEEE   EEE  EEEEE    EEEE
Rel_sec     56754320377888983577247886434023022235520330245401
SUB_sec     LLLL.....EEEEEEE.LLL..EEEE...........EE.......E...

O_3_acc     bbbbbbbbbbbbbbbbbbbbbbbbbbbbbbbbbbbbbbbbbbbbbbbbbb
P_3_acc     eee  bbbbbbb bbbb ee  b b   bbbbbb  bb b eeb bbe e
Rel_acc     17211105270744553301222473010244520230221020211103
SUB_acc     .e.....b.b.bibbb.......ib.....bbb.................

            ....,....31.1.,....32.1.,....33.1.,....34.1.,....35.1
AA          LPLIGEADCLHEKYGGLNKSKPYYTGEHAKAIGNCPIWVKTPLKLANGTK
OBS_sec
PROF_sec    HHH    HHHHH HHHHH
Rel_sec     32233333000113432246764334340342334133220003551573
SUB_sec     ...................LLL.......................HH.LL.

O_3_acc     bbbbbbbbbbbbbbbbbbbbbbbbbbbbbbbbbbbbbbbbbbbbbbbbbb
P_3_acc     e     e    e bb    ee  b      bbbebbe be bb bbbbb
Rel_acc     10010011112110110111101210102102111021712452461321
SUB_acc     ..................................b..bb.bb....

            ....,....36..1.,....37.1.,....38.1.,....39.1.,....40.1
AA          YRPPAKLLKERGFFGAIAGFLEGGWEGMIAGWHGYTSHGAHGVAVAADLK
OBS_sec
PROF_sec    EEEEHHHH                     EEEEE  H
Rel_sec     56853211324203110113404531100120021023564325530623
SUB_sec     LLLL..................L.............LL...EE..L..

O_3_acc     bbbbbbbbbbbbbbbbbbbbbbbbbbbbbbbbbbbbbbbbbbbbbbbbbb
P_3_acc     b  eee be  bbbbbbbbbbbbbb bbbbbbbbbbbbbb bbbbbbb e
Rel_acc     00011411202355999999623520456353043010011315264032
SUB_acc     .....e......bbbbbbbbb..b..bbb.b..b.........b.bb...

            ....,....41.1.,....42.1.,....43.1.,....44.1.,....45.1
AA          STQEAINKITKNLNYLSELEVKNLQRLSGAMNELHDEILELDEKVDDLRA
OBS_sec
PROF_sec    HHHHHHHHHHHHHHHHHHHHHHHHHHHHHHHHHHHHHHHHHHHHHH HHH
Rel_sec     47888989873212477733101234446677898888878756210111
SUB_sec     .HHHHHHHHH.....HHH.........HHHHHHHHHHHHHHHH......

O_3_acc     bbbbbbbbbbbbbbbbbbbbbbbbbbbbbbbbbbbbbbbbbbbbbbbbbb
P_3_acc     bbbebbeebbe b  bbee beebeeb ebbeebbe beeb eebee
Rel_acc     280498257253423222312063124534063444467553254223101
SUB_acc     .b.ebb.eb.e.b........e...eb.e.b.ebbeibee..ee......

            ....,....46.1.,....47.1.,....48.1.,....49.1.,....50.1
AA          DTISSQIELAVLLSNEGIINSEDEHLLALERKLKKMLGPSAVEIGNGCFE
OBS_sec
PROF_sec    HHHHHHHHHHHHHH         HHHHHHHHHHHHHHHHHHHH    EEE
Rel_sec     03645477777753464114550578879888887664424540663252
SUB_sec     ..H.H.HHHHHHH..L....LL.HHHHHHHHHHHHHH....H..LL..E.
```

-continued

```
O_3_acc    bbbbbbbbbbbbbbbbbbbbbbbbbbbbbbbbbbbbbbbbbbbbbbbbbb
P_3_acc    bbbb bb bbbbb  eebb  e e b eb e b e b e bee eebbbb
Rel_acc    04450592968651122001021323439443944173428232012340
SUB_acc    .bbb.bb.bbbbb.............i.bie.bie.b.e.b.......b.

           ....,....51.1.,....52.1.,....53.1.,....54.1.,....55.1
AA         TKHKCNQTCLDRIAAGTFNAGDFSLPTFDSLNITAASLNDDGLDNHTILL     (SEQ ID NO: 36)
OBS_sec
PROF_sec   EEEE  HHHHHHHH          HHHH  EEEEEEEEE      EEEEE
Rel_sec    22003402344311355466523223103101002476217776303665
SUB_sec    ...............LL.LLL..............EE..LLLL...EEE

O_3_acc    bbbbbbbbbbbbbbbbbbbbbbbbbbbbbbbbbbbbbbbbbbbbbbbbbb
P_3_acc    b beb e bbbbb bbbb  ee  eebbe beb bbeb eeeeeeb bbb
Rel_acc    42120312620271012211330320211224131235303222133868
SUB_acc    b.......b...b.................e.....b.........bbb

           ....,....56.1.,....57.1.,....58.1.
AA         YYSTAASSLAVTLMIAIFIVYMVSRDNVSCSICL                     (SEQ ID NO: 36)
OBS_sec
PROF_sec   EEEHHHHHHHHHHHHHHHHHHHH     EEEEEEE
Rel_sec    4310021478888888776321006740346860
SUB_sec    ........HHHHHHHHHHH.....LL....EEE.

O_3_acc    bbbbbbbbbbbbbbbbbbbbbbbbbbbbbbbbbb
P_3_acc    bbbbbbbbbbbbbbbbbbbbbbbbee eb b bbb
Rel_acc    6362366679999996998517101010152400
SUB_acc    b.b..bbbbbbbbbbbbbb.b.......b.b..
```

Figure 2:
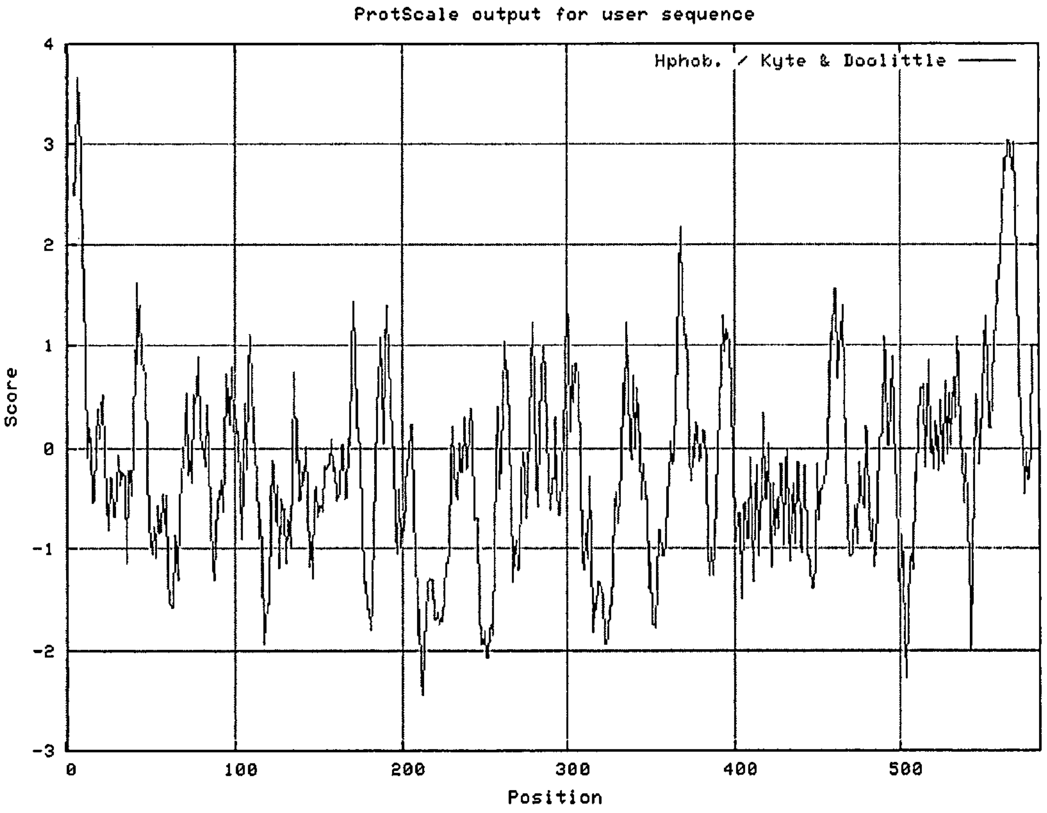
FIG. 2 depicts a hydrophobicity plot analysis of the B/Lee/40 HA (SEQ ID NO: 36) using ProtScale (http://ca.expasv.org/tools→Primary structure analvsis→ProtScale) to confirm that the selected boundaries were in the hydrophilic regions of the protein.

The third tool that used is the hydrophobicity analysis. In general, the structural core of a protein tends to be a hydrophobic cluster flanked by stretch of hydrophilic residues. Therefore the predicted boundaries should not locate in the center of hydrophobic core, rather should reside in the flanking hydrophilic regions. Hydrophobicity of B/Lee/40 HA sequence (SEQ ID NO: 36) was plotted using ProtScale (http://ca.expasy.org/tools→Primary structure analysis→ProtScale). The hydrophobicity analysis of B/Lee/40 sequence confirmed that the selected boundaries were in the hydrophilic regions of the protein (FIG. 2). The hydrophobicity strength used in the plot is listed in the following table:

SEQUENCE LENGTH: 584

Using the scale Hphob./Kyte & Doolittle, the individual values for the 20 amino acids are:

| | | | | | | | |
|---|---|---|---|---|---|---|---|
| Ala: | 1.800 | Arg: | -4.500 | Asn: | -3.500 | Asp: | -3.500 |
| Cys: | 2.500 | Gln: | -3.500 | Glu: | -3.500 | Gly: | -0.400 |
| His: | -3.200 | Ile: | 4.500 | Leu: | 3.800 | Lys: | -3.900 |
| Met: | 1.900 | Phe: | 2.800 | Pro: | -1.600 | Ser: | -0.800 |
| Thr: | -0.700 | Trp: | -0.900 | Tyr: | -1.300 | Val: | 4.200 |
| Asx: | -3.500 | Glx: | -3.500 | Xaa: | -0.490 | | |

In order to identify the HA 1-1 and HA1-2 domain boundaries of other influenza B molecules, such as B/Malaysia/2506/2004 (SEQ ID NO: 42), B/Ohio/1/2005 (SEQ ID NO: 43), B/Victoria/2/87 lineage (SEQ ID NO: 787) and B/Shanghai/361/2002 (SEQ ID NO: 44), and B/Yamagata/16/88 lineage (SEQ ID NO: 213), each HA sequence was aligned with B/Lee/40 HA sequence (SEQ ID NO: 36). The results indicated that influenza B HA proteins are much more conserved compared to influenza A HA proteins, especially in the domain boundary sequences. Thus, the boundaries identified in B/Lee/40 were used to direct boundary selections of other influenza B strains. The resulting domain boundaries for each strain are summarized below.

B/Malaysia/2506/2004: HA1-1 44-337 (SEQ ID NO: 45) (TTTPTK (SEQ ID NO: 287)-CPIWVK (SEQ ID NO: 288)) HA1-2 56-296 (SEQ ID NO: 46) (KGTETR (SEQ ID NO: 289)-SKVIKG (SEQ ID NO: 290))

B/Ohio/1/2005: HA1-1 33-326 (SEQ ID NO: 47) (TTTPTK (SEQ ID NO: 291)-CPIWVK (SEQ ID NO: 292)) HA1-2 45-285 (SEQ ID NO: 48) (KGTKTR (SEQ ID NO: 293)-SKVIKG (SEQ ID NO: 294))

B/Shanghai/361/2002: HA1-1 33-325 (SEQ ID NO: 49) (TTTPIK (SEQ ID NO: 295)-CPIWVK (SEQ ID NO: 296)) HA1-2 45-284 (SEQ ID NO: 50) (KGTRTR (SEQ ID NO: 297)-SKVIKG (SEQ ID NO: 298))

```
BMal ----IVLLMVVTSNADRICTGITSSNSPHVVKTATQGEVNVTGVIPLTTT   50 (SEQ ID NO: 42)
BOhi ---------------DRICTGITSSNSPHVVKTATQGEVNVTGVIPLTTT  (SEQ ID NO: 43)
BLee MKAIIVLLMVVTSNADRICTGITSSNSPHVVKTATQGEVNVTGVIPLTTT  (SEQ ID NO: 36)
BSha ---------------DRICTGITSSNSPHVVKTATQGEVNVTGVIPLTTT  (SEQ ID NO: 44)
     ---------------***********************************

BMal PTKSHFANLKGTETRGKLCPKCLNCTDLDVALGRPKCTGNIPSARVSILH  100
BOhi PTKSHFANLKGTKTRGKLCPKCLNCTDLDVALGRPKCTGNIPSAEVSILH
BLee PTKSHFANLKGTQTRGKLCPNCFNCTDLDVALGRPKCMGNTPSAKVSILH
Bsha PIKSHFANLKGTRTRGKLCPDCLNCTDLDVALGRPMCVGTTPSAKASILH
     * **********.*******.*:************ * *. ***..****
```

-continued

```
BMal EVRPVTSGCFPIMHDRTKIRQLPNLLRGYEHIRLSTHNVINAENAPGGSY  150
BOhi EVRPVTSGCFPIMHDRTKIRQLPNLLRGYEHIRLSTHNVINAEKAPGGPY
BLee EVKPATSGCFPIMHDRTKIRQLPNLLRGYENIRLSTSNVINTETAPGGPY
BSha EVRPVTSGCFPIMHDRTKIRQLPNLLRGYENIRLSTQNVIDAEKALGGPY
     **:*.*************************:***** ***::*.* **.*

BMal KIGTSGSCPNVTNGNGFFATMAWAVPKNDNNKTATNSLTIEVPYICTEGE  200
BOhi KIGTSGSCPNVTNGNGFFATMAWAVPKNDNNKTATNSLTIEVPYICTEGE
BLee KVGTSGSCPNVANGNGFFNTMAWVIPK-DNNKTAINPVTVEVPYICSEGE
BSha RLGTSGSCPNATSKSGFFATMAWAVPK-DNNKNATNPLTVEVPYICTEGE
     ::********.:. .*** ****.:** ****.* *.:*:******:***

BMal DQITVWGFHSDNEAQMAKLYGDSKPQKFTSSANGVTTHYVSQIGGFPNQT  250
BOhi DQITIWGFNSDSETQMAKLYGDSKPQKFTSSANGVTTHYVSQIGGFPNQT
BLee DQITVWGFHSDDKTQMERLYGDSNPQKFTSSANGVTTHYVSQIGGFPNQT
BSha DQITVWGFHSDDKTQMKNLYGDSNPQKFTSSANGVTTHYVSQIGGFPDQT
     ****:******.::** .*****:***********************:**

BMal EDGGLPQSGRIVVDYMVQKSGKTGTITYQRGILLPQKVWCASGRSKVIKG  300
BOhi EDGGLPQSGRIVVDYMVQKSGKTGTITYQRGILLPQKVWCASGRSKVIKG
BLee EDEGLKQSGRIVVDYMVQKPGKTGTIVYQRGILLPQKVWCASGRSKVIKG
BSha EDGGLPQSGRIVVDYMVQKPGKTGTIVYQRGVLLPQKVWCASGRSKVIKG
     ** ** *************.******.****:******************

BMal SLPLIGEADCLHEKYGGLNKSKPYYTGEHAKAIGNCPIWVKTPLKLANGT  350
BOhi SLPLIGEADCLHEKYGGLNKSKPYYTGEHAKAIGNCPIWVKTPLKLANGT
BLee SLPLIGEADCLHEKYGGLNKSKPYYTGEHAKAIGNCPIWVKTPLKLANGT
BSha SLPLIGEADCLHEKYGGLNKSKPYYTGEHAKAIGHCPIWVKTPLKLANGT
     **********************************:***************

BMal KYRPPAKLLKER--------------------------------------  400
BOhi KYRPPAKLLKERGF------------------------------------
BLee KYRPPAKLLKERGFFGAIAGFLEGGWEGMIAGWHGYTSHGAHGVAVAADL
BSha KYRP----------------------------------------------
     ****
```

B/Lee/40 HA1-1 construct design (SEQ ID NO: 38). For this construct, five (5) anticipated conserved disulfide bonds were preserved by making the amino terminal truncation before the Cysteine at position 69 and the carboxyl-terminal truncation after the Cysteine at position 335 of SEQ ID NO: 36. The likely disulfide pairings are as the following: C69 and C72, C75 and C87, C109 and C158, C195 and C289, C309 and C335 of SEQ ID NO: 36. Using the simulated structures and the MMDB to check secondary structures the amino terminal truncation was made at the Theonine at position 48, right after the β-strand kink introduced by Proline 46 followed by Leucine 47 of SEQ ID NO: 36, such that the preceding β-strand [TGVI, SEQ ID NO: 299, residues 42-45 of SEQ ID NO: 36] was totally eliminated while the entire short α-strand formed by residues TTTP (SEQ ID NO: 300) [residues 48-51 of SEQ ID NO: 36] was preserved. The carboxyl-terminal truncation was made at the end of β-strand PIWV (SEQ ID NO: 301) [residues 336-340 of SEQ ID NO: 36] following the Cysteine at position 335 such that the carboxyl-terminal tail which interacts with HA2 was completely eliminated. Six β-strands including the C-terminal β-strand form a stable β-sandwich defined by α-strands PIWV (SEQ ID NO: 301) [residue 336-340 of SEQ ID NO: 36], PYYTG (SEQ ID NO: 302) [residues 322 to 326 of SEQ ID NO: 36] and TTTP (SEQ ID NO: 300) [residues 48-51 of SEQ ID NO: 36] (lower β-pleated sheet), and the α-strands DCLHE (SEQ ID NO: 303) [residues 308-312 of SEQ ID NO: 38], YGGLN (SEQ ID NO: 3.04) [residue 314-318 of SEQ ID NO: 36] and KAIGN (SEQ ID NO: 305) [residues 330-334 of SEQ ID NO: 36] (top β-pleated sheet). This set of β-pleated sheet includes both the amino-terminus and carboxyl-terminus within one stable secondary structure element. Such truncations were made to believe resulting a compact domain structure.

B/Lee/40 HA1-2 construct design (SEQ ID NO: 39). For this construct four (4) anticipated conserved disulfide bonds were preserved by making the amino-terminal truncation before the Cysteine at position 69 and the carboxyl-terminal truncation after the Cysteine at position 289 of SEQ ID NO: 36. Using the simulated structure and the MMDB to check secondary structures the amino-terminal truncation was made in the loops that connect two distinct sets of β-pleated sheets. The amino-terminal truncation was made at the Lysine at position 60, such that the β-strand comprising residues 62-66 of SEQ ID NO: 36 [TQTRG, SEQ ID NO: 306] of the membrane-distal set of β-strands remained wholly intact, while the membrane-proximal β-strand [TTTP, SEQ ID NO: 300, residues 48-51 of SEQ ID NO: 36] that forms part of HA1-1 was completely eliminated. The carboxyl-terminal truncation was made at the Serine 300 of SEQ ID NO: 36. Truncation at this position preserved secondary structure such that the membrane-distal β-strand [KVIKG, SEQ ID NO: 307, residues 295-299 of SEQ ID NO: 36] remained intact while the membrane-proximal β-strand [DCLHE, SEQ ID NO: 308, residues 308-312 of SEQ ID NO: 36] was eliminated. The membrane-distal β-pleated sheets comprising β-strands TQTRG (SEQ ID NO: 306) [residues 62-66 of SEQ ID NO: 36], SILHEV (SEQ ID NO: 309) [residues 97-102 of SEQ ID NO: 36], and KVIKG (SEQ ID NO: 307) [residues 295-299 of SEQ ID NO: 36] serve as the stabilizing secondary structure element that is believed to conclude a compact domain structure.

B/Malaysia/2506/2004, B/Ohio/1/2005 and B/Shanghai/361/2002 follow the same reference structure as described above.

Example 3

Cloning and Expression of Recombinant Flagellin-Hemagglutinin Fusion Proteins in *E. Coli*

Materials and Methods

Cloning of HA influenza A subunits. Subunits of the HA globular head from several strains of influenza A were cloned and expressed alone or as fusions with flagellin. We also expressed in fusion with the HA globular head domain, two proteins widely used as carrier proteins in conjugated vaccines. CRM-197 is a mutated diphtheria toxin (DTx) from *Corynebacterium diphtheriae* and LTB, is *E. coli* heat labile toxin B subunit.

These constructs were generated in one of four different methodologies:

Method #1: In this protocol, a fusion gene comprising flagellin (STF2) (SEQ ID NO: 212) and the HA subunit was codon-optimized for *E. coli* expression and obtained from a commercial vendor (DNA2.0 Inc., Menlo Park, Calif.) by chemical synthesis. The gene was excised with NdeI and BlpI enzymes, the insert fragment was gel purified and ligated to pET24a (Novagen, San Diego, Calif.) which had been digested with NdeI and BlpI and treated with bacterial alkaline phosphatase (BAP).

Method #2: For facile cloning of genes in fusion with flagellin, a cassette plasmid containing a unique BlpI site at the 3' end of the flagellin (STF2) gene (SEQ ID NO: 212) was generated. This was done by introducing a silent mutation at nucleotides 5'-GTGCTGAGCCTGTTACGT-3' (SEQ ID NO: 310) [nt 1501 to 1518 of SEQ ID NO: 212] of STF2 creating the unique BlpI site in the plasmid cassette, pET24/STF2.blp (SEQ ID NO: 51). Synthetic genes for each target antigen were codon-optimized for *E. coli* expression and obtained from a commercial vendor (DNA2.0 Inc., Menlo Park, Calif.). The synthetic genes were excised with BlpI enzyme and ligated by compatible ends to pET24/STF2.blp which had been treated with BlpI and BAP.

Method #3: Using forward and reverse primers (Keck Foundation BRLK, Yale University, New Haven, Conn.; Midland Certified Reagent Company, Midland, Tex.) as indicated for each construct, PCR amplification was performed using the DNA templates shown in each table. The PCR product was subjected to BlpI digestion, gel-purified and ligated to pET24/STF2.blp (SEQ ID NO: 51) vector previously prepared by BlpI digestion and BAP treatment.

Method #4: A plasmid cassette, pET24/STF2.5G (SEQ ID NO: 52), was generated by introducing a flexible heptamer linker, Ser-Gly-Ser-Gly-Ser-Gly-Ser (S-G-S-G-S-G-S (SEQ ID NO: 311)) at the 3' end of the STF2 gene. A unique BamHI site was created in the linker to facilitate cloning of HA subunit fragments in fusion with flagellin. Synthetic genes codon-optimized for expression in *E. coli* were obtained from a commercial vendor (DNA2.0 Inc., Menlo Park, Calif.), excised from the parental plasmids with BamHI and BlpI restriction endonucleases, and ligated by compatible ends to the pET24/STF2 cassette that had previously been digested with BamHI and BAP-treated.

In each case, the constructed plasmids were used to transform competent *E. coli* TOP10 cells and putative recombinants were identified by PCR screening and restriction mapping analysis. The integrity of the constructs was verified by DNA sequencing and they were used to transform the expression host, BLR3 (DE3) (Novagen, San Diego, Calif.; Cat #69053). Transformants were selected on plates containing kanamycin (50 μg/mL), tetracycline (5 μg/mL) and glucose (0.5%). Colonies were picked and inoculated into 2 ml of LB medium supplemented with 25 μg/ml kanamycin, 12.5 μg/ml tetracycline and 0.5% glucose and grown overnight. Aliquots of these cultures were used to inoculate fresh cultures in the same medium formulation, which were cultured until they reached an $OD_{600}$=0.6, at which time protein expression was induced by the addition of 1 mM IPTG and culturing for 3 hours at 37° C. The cells were harvested and analyzed for protein expression.

SDS-PAGE and Western blot: Protein expression and identity were determined by gel electrophoresis and immunoblot analysis. Cells were harvested by centrifugation and lysed in Laemmli buffer. An aliquot of 10 μl of each lysate was diluted in SDS-PAGE sample buffer with or without 100 mM DTT as a reductant. The samples were boiled for 5 minutes and loaded onto a 10% SDS polyacrylamide gel and electrophoresed (SDS-PAGE). The gel was stained with Coomassie R-250 (Bio-Rad; Hercules, Calif.) to visualize protein bands. For western blot, 0.5 μl/lane cell lysate was electrophoresed and electrotransferred to a PVDF membrane and blocked with 5% (w/v) dry milk.

The membrane was then probed with either anti-flagellin antibody (Inotek; Beverly, Mass.) or influenza A PR/8/38 convalescent immune mouse serum. PR/8/34 immune serum was generated in BALB/c mice (Jackson Laboratory, Bar Harbor, Me.) that received an experimentally determined sublethal challenge dose of $8\times10^1$ egg infectious dosages (EID) of PR/8/34 influenza virus. Animals were then allowed to convalesce for >21 days post-infection at which time immune serum was isolated and clarified. After probing with alkaline phosphatase-conjugated secondary antibodies (Pierce; Rockland, Ill.), protein bands were visualized with an alkaline phosphatase chromogenic substrate (Promega, Madison, Wis.). Bacterial clones which yielded protein bands of the correct molecular weight and reactive with the appropriate antibodies were selected for production of protein for use in biological assays.

The constructs derived from the HA of A/Puerto Rico/8/34 strain (PR8) (SEQ ID NO: 1) and listed in Table 1 were made by the synthetic gene route as described in Method #1 and Method #4. Similarly, the constructs derived from the A/Viet Nam/1203/2004 strain (SEQ ID NO: 2) are shown in Table 2, the constructs derived from the HA of A/Indonesia/2005 strain (IND) (SEQ ID NO: 3) are described in Table 3, and those from A/New Caledonia/12/99 strain (NC) (SEQ ID NO: 4) are described in Tables 4. "IND" as used herein, refers to "Indonesia." Where appropriate, the DNA primers and DNA templates used in the PCR amplification reaction are listed in the same table.

TABLE 1

PR8 HA constructs for expression in *E coli*

| SEQ ID NO: | Construct | Method |
|---|---|---|
| 53 | STF2.HA1-1 | #4 |
| 54 | STF2.HA1-1.his | #4 |
| 55 | STF2.HA1-2 | #1 |
| 56 | STF2.HA1-2mut | #1 |
| 57 | STF2.HA1-3 | #1 |
| 58 | STF2.HA1-3mut | #1 |
| 59 | HA1-1 | #1 |
| 60 | HA1-1.his | #1 |
| 61 | HA1-2.his | #1 |
| 62 | CRM.HA1-2 | #1 |
| 63 | LTB.HA1-2 | #1 |

TABLE 2

VN HA constructs for expression in *E coli*

| SEQ ID NO: | Construct | Method | FOR Primer SEQ ID NO: | REV Primer SEQ ID NO: | DNA Template SEQ ID NQ: |
|---|---|---|---|---|---|
| 64 | STF2.HA1-1 | #3 | 65 | 66 | 67 |
| 68 | STF2.HA1-2 | #3 | 69 | 70 | 67 |

TABLE 2-continued

| VN HA constructs for expression in *E coli* | | | | | |
|---|---|---|---|---|---|
| SEQ ID NO: | Construct | Method | FOR Primer SEQ ID NO: | REV Primer SEQ ID NO: | DNA Template SEQ ID NQ: |
| 71 | STF2.HA1-2mut | #2 | N/A | N/A | 72 |

TABLE 3

| IND HA constructs for expression in *E coli* | | | | | |
|---|---|---|---|---|---|
| SEQ ID NO: | Construct | Method | FOR Primer SEQ ID NO: | REV Primer SEQ ID NO: | DNA Template SEQ ID NO: |
| 73 | STF2.HA1-1 | #3 | 74 | 66 | 75 |
| 76 | STF2.HA1-2 | #3 | 69 | 77 | 75 |
| 78 | STF2.HA1-2mut | #2 | N/A | N/A | 79 |

TABLE 4

| NC HA constructs for expression in *E coli* | | | | | |
|---|---|---|---|---|---|
| SEQ ID NO: | Construct | Method | FOR Primer SEQ ID NO: | REV Primer SEQ ID NO: | DNA Template SEQ ID NO: |
| 80 | STF2.HA1-1 | #3 | 81 | 82 | 83 |
| 84 | STF2.HA1-2 | #3 | 85 | 86 | 83 |
| 87 | STF2.HA1-2mut | #2 | N/A | N/A | 88 |

Results

Protein carriers have widespread application in human vaccines. The cross-reactive material ($CRM_{197}$) of diphtheria toxin is considered to be advantageous as a carrier molecule in the formulation of several conjugate vaccines. Exemplary carriers include *E. coli* heat labile enterotoxin (LT) and its B subunit (LTB), Tetanus toxoid (TT) and cholera toxin (CT). Using $CRM_{197}$ and LTB as representatives of this group of carrier proteins, we have generated constructs in which the globular head of HA of (A/Puerto Rico/8/34 strain (PR8) (SEQ ID NO: 1) is fused to the 3 end of either $CRM^{197}$ gene or LTB gene as described in Method #1 generating the constructs CRM.HA1-2 (SEQ ID NO: 62) and LTB.HA1-2(SEQ ID NO: 63). The constructs were verified by DNA sequencing and used to transform the expression host, BLR3 (DE3) (Novagen, San Diego, Calif.; Cat #69053).

Transformants were selected on plates containing kanamycin (50 μg/mL), tetracycline (5 μg/mL) and glucose (0.5%). Several colonies were picked for an overnight culture which were was used to inoculate a fresh LB medium supplemented with 25 μg/ml kanamycin, 12.5 μg/ml tetracycline and 0.5% glucose. At an OD600=0.6 protein expression was induced with 1 mM IPTG for 3 h at 37° C. The cells were harvested and an aliquot of the lysate was analyzed on 10% SDS-PAGE by Coomassie blue staining and by immunoblot using PR/8/34 convalescent sera. In the case of CRM.HA1-2 construct several clones were picked and analyzed for expression by SDS-PAGE.

As assayed by Coomassie blue staining of the SDS-PAGE gel, all the clones displayed a band that migrated with an apparent MW 84 KDa and that corresponds to the predicted MW. The absence of this band in the control culture (without IPTG) indicates that it is specifically induced by IPTG. This observation was further confirmed when the cell extracts of two clones #5 and #6 was fractionated in the presence or absence of a reducing agent (5 mM DTT). While the recombinant protein whose disulphide bonds have been disrupted by treatment with DTT is not recognized by the cognate antibodies, the native recombinant protein is. Similarly, a clone expressing construct LTB.HA1-2 displays a band corresponding to the predicted molecular weight of 39.8 KDa, protein when induced with IPTG. The identity of LTB-HA1-2 fusion protein is confirmed by western blot analysis using mouse convalescent serum. This band is diminished in intensity when a reductant (β-mercaptoethanol) was present. This latter observation suggests that insufficient amount of reductant was most likely employed in the experiment. Taken together the data presented herein support the notion that the globular head of HA can be successfully fused to carrier proteins to generate conformational sensitive proteins.

Cloning of Recombinant Flagellin-Hemagglutinin Fusion Proteins in *E. Coli*

Cloning of HA Influenza B subunits. Subunits of the HA globular head from several strains of influenza B were cloned and expressed as fusions with flagellin. These constructs were generated by a two-step PCR.

The HA subunit was codon-optimized for *E. coli* expression and obtained from a commercial vendor (DNA2.0 Inc., Menlo Park, Calif.) by chemical synthesis. The HA1-1 or HA1-2 was PCR amplified using the synthesized DNA as templates. The flagellin (STF2) sequence (SEQ ID NO: 212) was derived from the plasmid pET24a-STF2.HA1-2. The STF2 DNA fragment was PCR amplified, and the C-terminal of the PCR product has a 28-30 bp overlap with the N-terminal sequence of the fusion HA subunit.

The STF2 and HA subunits were fused together by a $2^{nd}$ PCR. Using respective forward and reverse primers (Integrated DNA Technologies, Inc, Coralville, Iowa 52241) listed below, fusion protein DNA was amplified from the DNA templates also shown below. The PCR product was subsequently subjected to XbaI digestion, gel-purification and ligation to pET24a-STF2.HA1-2 that was previously digested with XbaI and SnaBI.

The constructs are listed below, where appropriate, the DNA primers and DNA templates used in the PCR amplification reaction are also listed.

| FluB STF2.HA constructs for expression in *E coli* | | | | |
|---|---|---|---|---|
| SEQ ID NO: | Construct | FOR Primer SEQ ID NO: | REV Primer SEQ ID NO: | DNA Template SEQ ID NO: |
| 184 | STF2.HA1-1 (MAL) | 193, 195 | 194, 196 | 55, 183 |
| 186 | STF2.HA1-2 (MAL) | 193, 198 | 197, 199 | 55, 185 |
| 188 | STF2.HA1-2 (SH) | 193, 201 | 200, 202 | 55, 187 |
| 190 | STF2.HA1-2 (Lee) | 193, 204 | 203, 205 | 55, 189 |
| 192 | STF2.HA1-2 (Ohio) | 193, 207 | 206, 208 | 55, 191 |

In each case, the constructed plasmids were used to transform competent *E. coli* DH5α cells and putative recombinants were identified by restriction mapping. The integrity of the constructs was verified by DNA sequencing and was used to transform the expression host, BLR3 (DE3) (Novagen, San Diego, Calif.; Cat #69053). Transformants were selected on LB (Veggie peptone, EMD Bioscience, La Jolla, Calif.; Cat#71280; veggie yeast extract, EMD Bioscience, Cat#71279;) plates containing kanamycin (35 μg/mL). Colonies were picked and inoculated into 2 ml of LB (Veggie) medium supplemented with 35 μg/ml kanamycin and grown overnight. Aliquots of these cultures were used to inoculate fresh cultures in the same medium formulation, which were cultured until $OD_{600}$=0.6 was reached. The protein expression was induced by the addition of 1 mM IPTG. The cells were harvested after 2 hours culturing at 37° C. and analyzed for protein expression.

SDS-PAGE and Western blot: Protein expression and identity were determined by gel electrophoresis and immunoblot analysis. Cells were harvested by centrifugation and lysed in Tris/NaCl (50 mM Tris, 200 mM NaCl, pH 8.0) buffer. Two aliquots of each lysate was diluted in SDS-PAGE sample buffer and boiled for 5 minutes. One aliquot sample was reduced by DTT (200 mM final concentration, EMD Bioscience, La Jolla, Calif. 92039; Cat#233155). The samples (1.5 μl/lane cell lysate) were loaded onto a 4-12% SDS polyacrylamide gel and electrophoresed (SDS-PAGE). The gel was stained with Coomassie R-250 (Bio-Rad; Hercules, Calif.) to visualize protein bands.

For western blot, the duplicated gel was electrophoresed and electrotransferred to a PVDF membrane and blocked with 5% (w/v) dry milk. The membrane was then probed with either anti-flagellin antibody (6H11, Inotek, Beverly, Mass.; Lot#1030B5) or ferret antiserum raised against B/Malaysia (2506/2004, CDC#2005741987). After probing with Horseradish Peroxidase (HRP)-conjugated secondary antibodies (1:10,000) (Goat anti-Mouse is from Jackson ImmunoResearch Laboratories; West Grove, Pa. Goat anti-Ferret is from Bethyl Laboratories; Montgomery, Tex.), protein bands were visualized after with addition of TMB, an HRP chromogenic substrate (Pierce; Rockland, Ill.; Cat#34018). The approximate molecular weight of STF2.HA1-1 (MAL) is 84 kDa; and the approximate molecular weight of STF2.HA1-2 (MAL and SH) is ~78 kDa. Two micrograms of STF2.4×M2e fusion protein was loaded as a positive control for the anti-flagellin antibody and a negative control for the anti-HA sera. Virus lysate (B/Malaysia/2506/04, CDC#2005756250) was included in the experiment as a positive control for the anti-HA sera and a negative control for the anti-flagellin antibody. Coomassie blue staining of the gel showed low induction of STF2.HA1-1 (MAL) protein; but much stronger bands for STF2.HA1-2(MAL) and STF2.HA1-2(SH) proteins. Western blot analysis using anti-flagellin monoclonal antibodies (1:4000) exhibited a strong positive band around 84 kDa for lanes loaded with STF2.HA1-1(MAL), and around 75 kDa in lanes loaded with STF2.HA1-2(MAL) or STF2.HA1-2(SH). The induction pattern of each fusion protein on the Western is very similar to the result for the coomassie blue stained gel. The level of the non-reduced and the reduced protein recognized by the anti-flagellin was comparable. The positive control for anti-flagellin (STF2.4×M2e) showed s single strong band, and the negative control exhibited no signal.

Western blot analysis using anti-HA polyclonal anti-sera (1:1000) exhibited a similar pattern as the blot with anti-flagellin, except that the reduced STF2.HA1-2 protein had a diminished signal compared to that of the non-reduced sample, indicating that a substantial portion of the anti-HA polyclonal antibodies in the antiserum recognize conformational epitopes formed by correct disulfide-bond formation while a small proportion of the antibodies in the anti-sera recognize linear epitopes that are not reliant on disulfide bound formation. Similar were observed using a capture ELISA assay. It is worth noting that anti-serum against B/Malaysia/2506/2004 (Victoria lineage) also recognizes B/Shanghai/361/2002, which belongs to Yamagata lineage. This result indicates that these two lineages not only share substantial primary sequence similarity, but also share tertiary structure.

The western blot and ELISA results confirm the expression of functional Influenza B HA1-1 and HA 1-2 fusion protein in *E. coli*.

Example 4

Purification and Biochemical Characterization of Recombinant Flagellin-Hemagglutinin Fusion Proteins

Materials and Methods

Bacterial growth and cell lysis: HA constructs were expressed in the *E. coli* host strain BLR (DE3). *E. coli* cells carrying a plasmid encoding STF2.HA1-1.his(PR8) (SEQ ID NO: 54) were cultured and harvested as described above. Individual strains were retrieved from glycerol stocks and grown in shake flasks to a final volume of 12 L. Cells were grown in LB medium containing 50 μg/ml kanamycin/12.5 μg/ml tetracycline/0.5% dextrose to $OD_{600}$=0.6 and induced with 1 mM IPTG for 3 h at 37° C. The cells were harvested by centrifugation (7000 rpm×7 minutes in a Sorvall RC5C centrifuge) and resuspended in 1×PBS, 1% glycerol, 1 μg/ml DNAseI, 1 mM PMSF, protease inhibitor cocktail and 1 mg/ml lysozyme. The cells were then lysed by two passes through a microfluidizer at 15,000 psi. The lysate was centrifuged at 45,000 g for one hour in a Beckman Optima L ultracentrifuge (Beckman Coulter; Fullerton, Calif.) to separate the soluble and insoluble fractions Purification and refolding of STF2.HA1-1.his(PR8) (SEQ ID NO: 89) protein from *E. coli*. Following lysis and centrifugation, the insoluble (pellet) fraction was resuspended in 100 ml 1×TBS, pH 8.0+1 mM β-mercaptoethanol and solid urea was added to a final concentration of 6.2 M. After resuspension with a Dounce glass-ball homogenizer the mixture was centrifuged as described above. The resulting supernatant was loaded onto a chelating sepharose column (GE/Amersham Biosciences; Piscataway, N.J.) charged with $NiSO_4$ and equilibrated in Buffer A [20 mM Tris, pH 8.0/8 M urea/0.5 M NaCl].

After washing with 1 L buffer B [Buffer A+1% (w/v) TX-100] the column was eluted in a 5-column volume linear gradient from 100% Buffer A to 100% Buffer C [Buffer A+0.5 M imidazole]. Peak fractions were pooled, concentrated 3.5 fold on an Amicon 15 spin concentrator (Millipore; Billerica, Mass.) and dialyzed against 3×2 L of 8 M urea/20 mM Tris, pH 8.0/2 mM EDTA. Following dialysis, STF2.HA1-1.his(PR8) (SEQ ID NO: 89) was refolded by rapid dilution to a final concentration of 0.1 mg/ml protein in Refolding Buffer [0.1 M Tris, pH 8.0/0.1 M NaCl/1% (w/v) glycerol/5 mM reduced glutathione/1 mM oxidized glutathione] and incubated overnight at room temperature.

The refolded protein was then captured on a 5 ml chelating sepharose HiTrap column (GE/Amersham Biosciences; Piscataway, N.J.) charged with $NiSO_4$ and equilibrated in Buffer D [20 mM Tris, pH 8.0/0.5 M NaCl/1 mM reduced glutathione/0.2 mM oxidized glutathione] and eluted in 100% Buffer E [Buffer D+0.5 M imidazole]. Peak eluate fractions were pooled, concentrated using an Amicon 15 spin concentrator (Millipore; Billerica, Mass.) and fractionated on a Superdex 200 size-exclusion column (GE/Amersham; Piscataway, N.J.) equilibrated in 1×TBS, pH 8.0+0.5% (w/v) Na deoxycholate. S200 peak fractions were pooled, dialyzed against 3×2 L of 1×TBS, pH 8.0 (without deoxycholate), vialed and stored at −80° C.

Purification of STF2.HA1-2(PR8) (SEQ ID NO: 90) and STF2.HA1-2mut(PR8) (SEQ ID NO: 91): *E. coli* cells carrying a plasmid encoding STF2.HA1-2.his (PR8) (SEQ ID NO: 55) were cultured and harvested as described above. Following lysis and centrifugation, the insoluble (pellet) fraction containing STF2.HA1-2(PR8) was resuspended and homogenized in 50 mM Tris, pH 8.0+0.5% (w/v) Triton X-100 using a Dounce homogenizer. The homogenate was then centrifuged (19,000 rpm×10 min). The resulting pellet fraction was then re-homogenized in 50 mM Tris, pH 8.0+0.5% (w/v) Triton X-100+1.0 M NaCl and centrifuged. The inclusion body fraction (pellet) was then dissolved in buffer A [50 mM Na Acetate, pH 4.0+8.0 M urea] and centrifuged (19,000 rpm×10 min.) to remove insoluble debris.

The resulting supernatant was fractionated on a Source S column (GE/Amersham Biosciences; Piscataway, N.J.) equilibrated in Buffer A and eluted in a 5 column-volume linear gradient with Buffer B (50 mM Na Acetate, pH 4.0, 1.0 M NaCl). The protein was then refolded by rapid dilution into Buffer C (100 mM Tris-HCl, pH 8.0). The refolded protein was then fractionated on a Q sepharose HP column (GE/Amersham Biosciences; Piscataway, N.J.) equilibrated-in-Buffer C and eluted in a 0% to 60% linear gradient with buffer D (Buffer C+1 M NaCl). The Q HP eluate was then fractionated on a Superdex 200 size exclusion chromatography (SEC) column (GE/Amersham Biosciences; Piscataway, N.J.) equilibrated with 1× Tris-buffered saline, pH 8.0, to separate monomeric from aggregated protein. Monomeric fractions were then pooled, aliquoted and stored at −80° C.

Purification of STF2.HA1-3(PR8) (SEQ ID NO: 92): *E. coli* cells carrying a plasmid encoding STF2.HA1-3 (PR8) (SEQ ID NO: 57) were cultured and harvested as described above. Following lysis and centrifugation the soluble (supernatant) fraction containing STF2.HA1-3(PR8) was adjusted to 6.2 M urea, 100 mM DTT and incubated at room temperature overnight to completely reduce and denature the protein. The protein was then diluted five-fold in Buffer A (50 mM citric acid, pH 3.5, 8 M urea, 1 mM β-mercapto ethanol, 0.1 mM EDTA) and loaded onto an SP sepharose FF column (GE/Amersham Biosciences; Piscataway, N.J.) equilibrated with Buffer A. To remove endotoxin, the column washed with 10 column volumes of Buffer B (Buffer A+1% (w/v) Triton X-100) followed by 10 column volumes Buffer C (50 mM citric acid, pH 3.5, 1 mM β-mercaptoethanol, 1 mM EDTA, 70% (v/v) isopropanol).

The bound protein was then eluted in a five column-volume linear gradient of Buffer A:Buffer D (Buffer A+1M NaCl). The eluted protein was then dialyzed to Buffer E (20 mM Tris, pH 8.5, 8 M urea, 1 mM β-mercaptoethanol, 1 mM EDTA) and passed through a Source Q column (GE/Amersham Biosciences; Piscataway, N.J.). The STF2.HA1-3(PR8) (SEQ ID NO: 92) protein was collected in the flow-thru fraction. The protein was concentrated using Amicon spin-concentrators (Millipore; Billerica, Mass.) and dialyzed to Buffer F (20 mM Tris, pH 8.0, 8 M urea, 1 mM EDTA) to remove reductant. The denatured polypeptide was then refolded by rapid dilution to a final concentration of 0.1 mg/ml in Refolding Buffer (0.1 M Tris, pH 8.0, 0.1 M NaCl, 1% (w/v) glycerol, 5 mM reduced glutathione, 1 mM oxidized glutathione) and incubated overnight at room temperature. The refolded protein was then fractionated on a Superdex 200 size exclusion column equilibrated in 1× Tris-buffered saline (TBS), pH 8.0, plus 0.25% (w/v) sodium deoxycholate to separate monomeric STF2.H1-3(PR8) from aggregated protein. Monomeric peak fractions were pooled, dialyzed to 1×TBS, pH 8.0, to remove deoxycholate, aliquoted and stored at −80° C.

Purification of HA1-2His(PR8) (SEQ ID NO: 93): *E. coli* cells carrying a plasmid encoding STF2.HA1-2.his (PR8) (SEQ ID NO: 61) were cultured and harvested as described above. Following cell lysis the insoluble fraction was homogenized and washed once with Buffer A (50 mM Tris, pH 8.0), followed by sequential washing with Buffer A+0.5% (w/v) Triton X-100 and Buffer A+0.5% (w/v) Triton X-100+μM NaCl. The insoluble material was then washed twice more with Buffer A alone. The washed inclusion bodies were then dissolved in Buffer B (1×PBS, pH 7.4, 8 M urea) and applied to a Ni-NTA (Sigma-Aldrich; St. Louis, Mo.) column charged with $NiSO_4$ and eluted in a linear gradient of Buffer C (50 mM Tris, pH 8.0, 8 M urea, 0.3 M NaCl, 0.5 M imidazole). In order to reduce endotoxin, the eluted protein was dialyzed overnight against 1×PBS, pH 7.4, 8 M urea, and reapplied to the Ni-NTA column.

The column was then washed with Buffer D (10 mM Tris, pH 8.8, 8 M urea, 60% (v/v) isopropanol) and eluted as described above. Ni-NTA purified protein was then refolded by 1:10 (v/v) dilution into Refolding Buffer (50 mM Tris, pH 8.8). The refolded HA1-2 His(PR8) (SEQ ID NO: 93) protein was then concentrated using an Amicon ultrafiltration unit (Millipore; Billerica, Mass.) and applied to a Superdex 200 size exclusion column (GE/Amersham; Piscataway, N.J.) equilibrated in 1×TBS, pH 8.0. Monomeric peak fractions were pooled, aliquoted and stored at −80° C.

SDS-PAGE and western blot analysis: Protein identity of all HA constructs was determined, and purity estimated, by SDS-PAGE. An aliquot of 5 μg of each sample was diluted in SDS-PAGE sample buffer with or without 100 mM DTT as a reductant. The samples were boiled for 5 minutes and loaded onto a 10% SDS polyacrylamide gel (LifeGels; French's Forrest, New South Wales, AUS) and electrophoresed. The gel was stained with Coomassie R-250 (Bio-Rad; Hercules, Calif.) to visualize protein bands. For western blot, 0.5 μg/lane total-protein was electrophoresed as described above and the gels were then electro-transferred to a PVDF membrane and blocked with 5% (w/v) dry milk before probing with anti-flagellin antibody (Inotek; Beverly, Mass.) or influenza A PR/8/34 Convalescent immune serum (described below under Protein Antigenicity ELISA). After probing with alkaline phosphatase-conjugated secondary antibodies (Pierce; Rockland, Ill.), protein bands were visualized with an alkaline phosphatase chromogenic substrate (Promega; Madison, Wis.).

Protein assay: Total protein concentration for all proteins was determined using the Micro BCA (bicinchoninic acid) Assay (Pierce; Rockford Ill.) in the microplate format, using bovine serum albumin as a standard, according to the manufacturer's instructions.

Endotoxin assay: Endotoxin levels for all proteins were determined using the QCL-1000 Quantitative Chromogenic LAL test kit (Cambrex; E. Rutherford, N.J.), following the manufacturer's instructions for the microplate method.

TLR5 bioactivity assay: HEK293 cells constitutively express TLR5, and secrete several soluble factors, including IL-8, in response to TLR5 signaling. Cells were seeded in 96-well microplates (50,000 cells/well), and the following test proteins were added and incubated overnight: STF2.HA1-1His(PR8) (SEQ ID NO: 89); STF2.HA1-2 (PR8) (SEQ ID NO: 90); STF2.HA1-2(PR8)mut (SEQ ID NO: 91); STF2.HA1-3(PR8) SEQ ID NO: 92); HA1-2His (PR8) (SEQ ID NO: 93); STF2.HA1-2 (Mal) (SEQ ID NO: 211) supernatant; STF2. HA1-2 (Mal) (SEQ ID NO: 211) refolded; STF2.HA1-2 (SH) (SEQ ID NO: 211) supernatant;

STF2.HA1-2 (SH) (SEQ ID NO: 211) refolded; STF2.HA1-1 (Mal) (SEQ ID NO: 209) supernatant; and STF2.HA1-1 (Mal) (SEQ ID NO: 209). The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce, Rockland, Ill.; #M801E and #M802B) following the manufacturer's instructions. Optical density was measured using a microplate spectrophotometer (FARCyte, GE/Amersham; Piscataway, N.J.).

Protein antigenicity ELISA: To determine whether the recombinant fusion proteins displayed correctly folded epitopes of HA, the antigenicity of individual HA-fusion proteins was evaluated by ELISA. 96-well ELISA plates were coated overnight at 4° C. with serial dilutions in PBS (100 μl/well) of each target protein starting at 5 μg/ml. Plates were blocked with 200 μl/well of Assay Diluent Buffer (ADB; BD Pharmingen) for one hour at room temperature, then washed three times in PBS-T. A fixed dose of primary antibody was then added to each well.

To assay HA reactivity, 100 μl/well of a 1:10,000 dilution of non-immune or PR/8/34 convalescent immune serum in ADB was added. PR/8/34 immune serum was generated in BALB/c mice (Jackson Laboratory, Bar Harbor, Me.) that received an experimentally determined sublethal challenge dose of $8\times10^1$ egg infectious dosages (EID) of PR/8/34 influenza virus. Animals were then allowed to convalesce for >21 days post-infection at which time immune serum was isolated and clarified. For ELISA of flagellin or the 6× histidine tag, monoclonal antibody against 6× His (Invitrogen; Carlsbad, Calif.), or flagellin (Inotek; Beverly, Mass.) was added at 1 μg/ml in ADB (100 μl/well) and the plates were incubated for 1 hr at room temperature or overnight at 4° C. The plates were then washed three times with PBS-T. HRP-labeled goat anti-mouse IgG antibodies (Jackson Immunochemical; West Grove, Pa.) diluted in ADB were added (100 μl/well) and the plates were incubated at room temperature for 1 hour. The plates were washed three times with PBS-T. After adding TMB Ultra substrate (Pierce; Rockford, Ill.) and monitoring color development, $A_{450}$ was measured on a microplate spectrophotometer (FARCyte, GE/Amersham; Piscataway, N.J.).

Results and Discussion

Protein yield and purity: Results for the purification of recombinant HA and STF2.HA fusion proteins produced in *E. coli* are shown in Table 6. All four proteins were produced in high yield, with estimated purity exceeding 90% and endotoxin well below the standard acceptable level of 0.1 EU/μg. The three STF2 fusion proteins also had very high in vitro TLR5 bioactivity while the HA1-2$His_6$ (SEQ ID NO: 93) protein, as expected, had no TLR5 activity:

TABLE 6

| protein | SEQ ID NO: | yield (mg) | purity est. (%) | endotoxin (EU/μg) | TLR5 activity ($EC_{50}$, ng/ml) |
|---|---|---|---|---|---|
| STF2.HA1-1His(PR8) | 89 | 6.4 | >90 | 0.04 | 0.2 |
| STF2.HA1-2(PR8) | 90 | 6.0 | >98 | 0.02 | 0.15 |
| STF2.HA1-2(PR8)mut | 91 | 12 | >95 | 0.01 | 1.2 |
| STF2.HA1-3(PR8) | 92 | 2.1 | >90 | 0.016 | 1.2 |
| HA1-2His(PR8) | 93 | 10 | >95 | 0.03 | nd |

Antigenicity of Influenza A HA proteins produced in *E. coli*.: All four recombinant proteins were analyzed by western blotting with antibody against STF2 (flagellin) (Inotek; Beverly, Mass.) and immune antisera collected from PR/8/34 convalescent mice. The three STF2 fusion proteins appeared to react comparably with anti-flagellin antibody. STF2.HA1-1His(PR8) (SEQ ID NO: 89), STF2.HA1-2(PR8) (SEQ ID NO: 90) and HA1-2His(PR8) (SEQ ID NO: 93) also reacted with anti-PR/8/34 convalescent serum. This reactivity was only seen in non-reduced protein samples; the addition of DTT to the sample buffer greatly diminished the signal. This finding suggests that the majority of the anti-HA antibodies in the convalescent serum are conformationally dependent and that proper disulfide bonding in HA is necessary for reactivity by western blot. In contrast to these results, STF2.HA1-3 (PR8) (SEQ ID NO: 92) did not react efficiently with the convalescent serum and what little signal was produced was not affected by reductant. This finding suggested that the STF2.HA1-3 protein may not be capable of folding properly and/or presenting native HA epitopes.

Capture ELISA for Influenza B Globular Head Proteins

The antigenicity of individual HA-fusion proteins was evaluated using capture ELISA. An anti-flagellin monoclonal antibody was used on the solid phase to capture these proteins. Ferret anti-sera raised on natural B/Malaysia/2506/2004 infection was used to detect the captured HA-fusion proteins. The results of this assay will determine whether the recombinant fusion proteins displayed correctly-folded epitopes of HA. Due to the considerable sequence homology between the different Influenza B HA globular head molecules, 84.6%, these antisera would be expected to react with both the Malaysian and the Shanghai globular head constructs.

Preparation of Samples

*E. coli* cells expressing the STF2.HA1-2(Malaysia (SEQ ID NO: 210)), STF2.HA1-2(Shanghai (SEQ ID NO: 211)), and STF2.HA1-1 (Malaysia (SEQ ID NO: 209)) recombinant proteins were pelleted by centrifugation and resuspended in Tris buffer (50 mM Tris, 200 mM NaCl, pH 8). Cells were lysed by sonication. The cell lysate was centrifuged to separate the soluble proteins from the insoluble proteins. The insoluble protein pellet was resuspended in Tris buffer with 6M urea and the proteins were subjected to rapid refolding by quickly diluting the solution 1:10 fold in Tris buffer. The protein concentrations of both the soluble proteins and the pelleted samples containing refolded proteins were estimated by UV $_{280}$ (Spectrophotometer DU 800). Supernatants containing STF2.HA1-1(Mal) (SEQ ID NO: 209); STF2.HA1-2 (Mal) (SEQ ID NO: 210), STF2.HA1-2(SH, Shanghai) (SEQ ID NO: 211) protein and solubilized pellets containing refolded STF2.HA1-1(Mal), STF2.HA1-2(Mal), STF2.HA1-2(SH) were evaluated by ELISA for reactivity with ferret antisera raised on natural infection against B/Malaysia/2506/2004. *E. coli* supernatant samples and solubilized, refolded samples containing STF2.4×M2e (SEQ ID NO: 94) protein were used as negative controls.

ELISA Method

The ELISA plate (Maxisorp, Nunc, Denmark) was coated with the flagellin-specific monoclonal antibody 6H11 (Inotek, Beverly, Mass.) at 0.5 ug/mL and incubated overnight at 2-5° C. The antibody coating solution was aspirated and the wells were blocked with 300 uL/well Super Block+Tween-20 for 2 hours at 25° C. The plate was washed once with 1×PBS and blot-dried. Three-fold serial dilutions of the different protein solutions were performed in a dilution plate starting with a concentration of 5 ug/mL. 100 uL was transferred from the dilution plate to the ELISA plate.

The plate was incubated for 1 hr at 25° C. Unbound protein was removed by washing the plate 3 times with PBS+0.05%

Tween-20. Ferret antiserum raised against B/Malaysia/2506/2004 (CDC, AL, Georgia) was diluted to 1:100 and 100 uL was added to each well. The plate was then incubated for 1 hr at 25° C. After this incubation step, the plates were washed 6 times with PBS containing 0.05% Tween-20. Goat anti-ferret IgG conjugated to horseradish peroxidase (HRP, Bethyl Labs Inc., IL) was diluted 1:10,000 and 100 uL was added to each well. The plate was incubated for 30 min. After this incubation step, the plate washed 6 times with PBS+0.05% Tween-20. 100 uL of TMB Ultra containing the HRP substrate 3,3',5,5'-tetramethylbenzidine (Pierce, Rockford, Ill.) was added to each well. After the addition of this substrate, the color development was monitored and the reaction was stopped with the addition of 100 uL/well 1M $H_2SO_4$. $A_{450}$ was measured on a microplate reader (SpectraMax 190, Molecular devices, Sunnyvale, Calif.).

Antigenicity of Influenza B HA Proteins Produced in *E. Coli*

Figure 3:
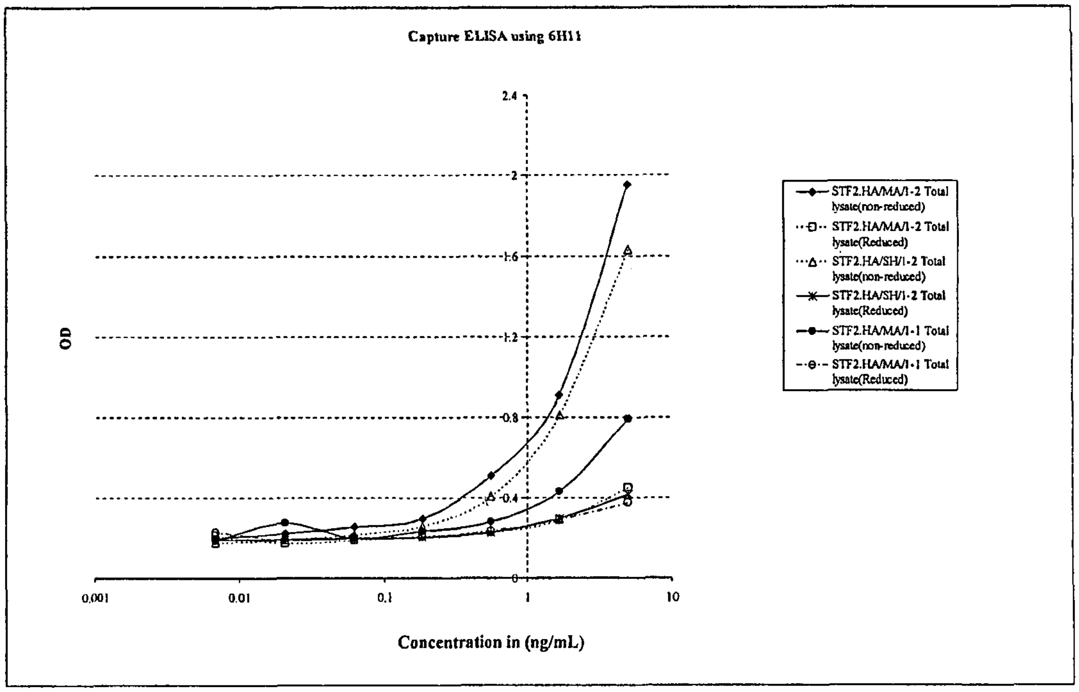
FIG. 3 depicts a sandwich ELISA analysis of STF2.HA B strain proteins. ELISA plates were coated with antibody to flagellin, and the indicated proteins were incubated to allow capture. Proteins were detected using ferret antisera against B/Malaysia/2506/2004 and enzyme-labeled goat anti-ferret antibodies.

The ELISA data (FIG. 3) indicated that the antisera recognized epitopes that were sensitive to reductant. Treatment of proteins with reducing agents, which alter the conformation of the proteins by the disruption of disulphide bonds and, diminished reactivity of the antisera with the proteins. The reactivity of STF2.HA1-2(Mal) total lysate non-reduced, STF2.HA1-2(SH) total lysate non-reduced and STF2.HA1-1 (Mal) total lysate non-reduced when maintained in the properly folded configuration was very good and indicates that the conformation of the individual HA-fusion proteins was comparable to that of the globular head in the native HA protein. While the antiserum contains conformationally sensitive antibodies and the reactivity depends on correct disulfide bonding, it also contains antibodies that are non-sensitive to disulfide bonding as demonstrated by the residual activity which was observed in both reduced and non reduced conditions.

TLR5 Bioactivity of STF2.HA (Influenza B) Proteins

Figure 4:
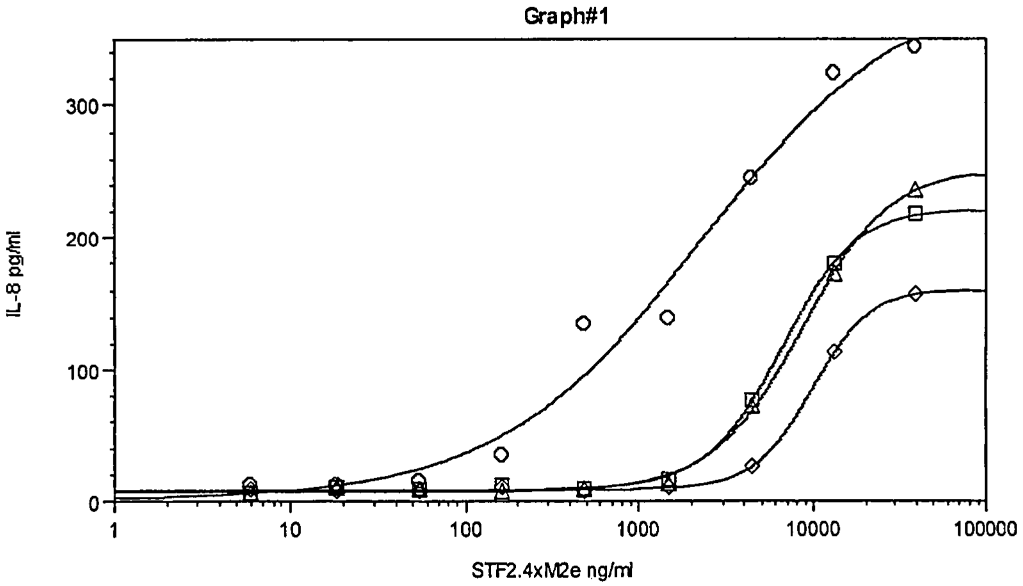
FIG. 4 depicts the TLR bioactivity of STF2.HA B strain proteins. HEK293 (TLR5+) cells were incubated with the indicated proteins overnight and the cell culture supernatants were harvested and assessed for IL-8 by ELISA.
Figure 5:
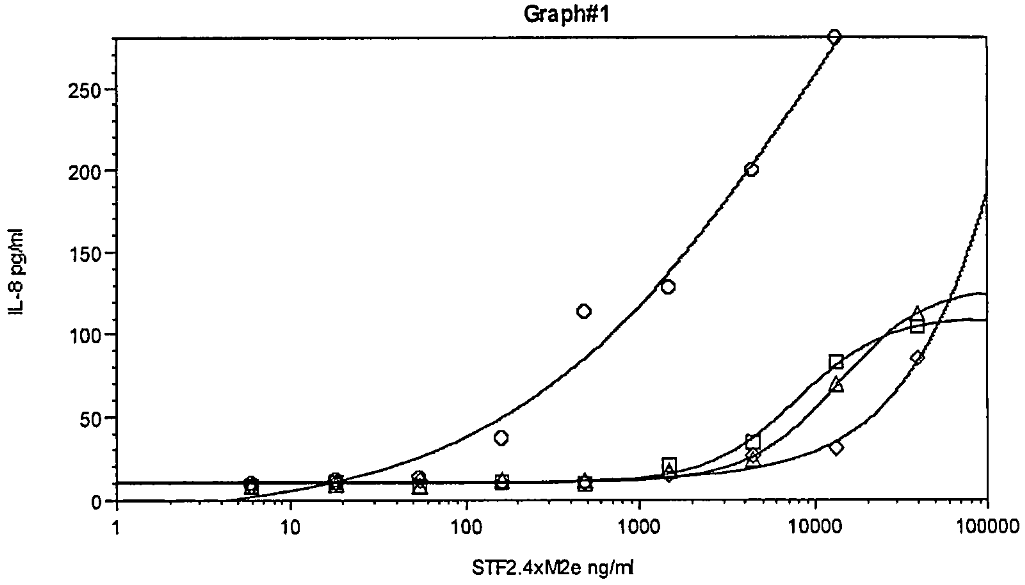
FIG. 5 depicts the TLR bioactivity of STF2.HA B strain proteins. HEK293 (TLR5+) cells were incubated with the indicated proteins overnight, and the cell culture supernatants were harvested and assessed for IL-8 by ELISA.

The recombinant fusion proteins showed potency which matched the results from the Capture ELISA indicating that refolded samples may be more active than the lysate in its native form (FIGS. 4 and 5). The samples in the native untreated form showed activity which were 2-fold less than the refolded samples. These proteins were misfolded in the native form and therefore require a refolding step to reinstall the TLR-5 bioactivity. This activity was consistent with HA activity in the Capture ELISA.

Example 5

Immunogenicity of Recombinant Flagellin-Hemagglutinin Fusion Proteins Representing Viral Strain A/Puerto Rico/8/34 in *E. Coli*

Materials and Methods

Animal studies: Female BALB/c mice (Jackson Laboratory, Bar Harbor, Me.)) were used at the age of 6-8 weeks. Mice were divided into groups of 10 and received inguinal subcutaneous (s.c) immunizations on days 0 and 14 as follows:

1) PBS (phosphate buffered saline).

2) 3 μg of STF2.4×M2e (SEQ ID NO: 94) in saline buffer (10 mM Histidine, 10 mM Tris, 75 mM NaCl, 5% (vol/vol) sucrose, 0.02% (w/v) Polysorbate-80, 0.1 mM EDTA, 0.5% (v/v) ethanol, pH 7.2)

3) 30 μg of STF2.HA1-2(PR8) (SEQ ID NO: 90) in PBS 4) 3.0 μg of STF2.HA1-2(PR8) (SEQ ID NO: 90) in PBS 5) 0.3 μg of STF2.HA1-2(PR8) (SEQ ID NO: 90) in PBS 6) 0.03 μg of STF2.HA1-2(PR8) (SEQ ID NO: 90) in PBS

An additional group of five mice received an experimentally determined sublethal challenge with $8\times10^1$ egg infectious dosages (EID) PR/8/34 and were allowed to convalesce for >21 days. These animals were then used as immune convalescent positive controls during the challenge studies (see below). Mice were bled on days 10 (primary) and 21 (boost), and sera were clarified by clotting and centrifugation and stored at −20° c.

Serum antibody determination: HA-specific IgG levels were determined by ELISA. 96-well ELISA plates (Costar (Cat #9018) Corning, N.Y.) were coated overnight at 4° C. with 100 μl/well HA0sHis protein (produced in *Drosophila*) (SEQ ID NO: 176) in PBS (5 μg/ml). Plates were blocked with 200 μl/well of Assay Diluent Buffer (ADB; BD Pharmingen, (Cat#: 555213)(San Diego, Calif.) for one hour at room temperature. The plates were washed three times in PBS+0.05% (v/v) Tween 20 (PBS-T). Dilutions of the sera in ADB were added (100 μl/well) and the plates were incubated overnight at 4° C. The plates were washed three times with PBS-T. HRP-labeled goat anti-mouse IgG antibodies (Jackson Immunochemical, West Grove, Pa. (Cat#: 115-035-146)) diluted in ADB were added (100 μl/well) and the plates were incubated at room temperature for 1 hour. The plates were washed three times with PBS-T. After adding TMB Ultra substrate (Pierce (Cat 34028), Rockford, Ill.)) and monitoring color development, $A_{450}$ was measured on a Tecan Farcyte (Durham, N.C.) microplate spectrophotometer.

MDCK whole cell ELISA: MDCK cells (ATCC (Cat#CCL-34) Manassas, Va.) were grown in 96-well culture plates (BD (Cat 353075), Corning, N.Y.) in DMEM complete medium containing 10% FCS at 37° C. for one to two days or until cells were near confluence. Wells were then incubated with $1\times10^6$ EID of PR/8/34 virus (50 μl) in DMEM medium without FCS or medium alone (for uninfected controls).

Following a 60 minute incubation at 37° C., 200 μl of complete medium was added to each well and plates were incubated overnight at 37° C. The next day plates were washed with PBS and fixed with 10% formalin at room temperature for 10 minutes. Wells were washed three times with PBS/0.1% BSA and blocked with 200 μl/well ADB (BD Pharmingen, Cat#555213), San Diego, Calif.) for one hour at RT or overnight at 4° C. Serial dilutions of test sera were added to the wells and incubated for one to two hours at room temperature. Wells were washed and incubated with HRP-conjugated goat anti-mouse IgG (Jackson Immunochemical, Cat 115-035-146 (West Grove, Pa.) for 30 minutes at room temperature, followed by TMB Ultra substrate (Pierce (Cat#34028), Rockford, Ill.) for two minutes at room temperature. The reaction was stopped with the addition of 25 μl of 1N $H_2SO_4$ and the $OD_{450}$ was read using a microplate spectrophotometer (FARCyte, Amersham, Durham, N.C.).

Results and Discussion

Figure 6:
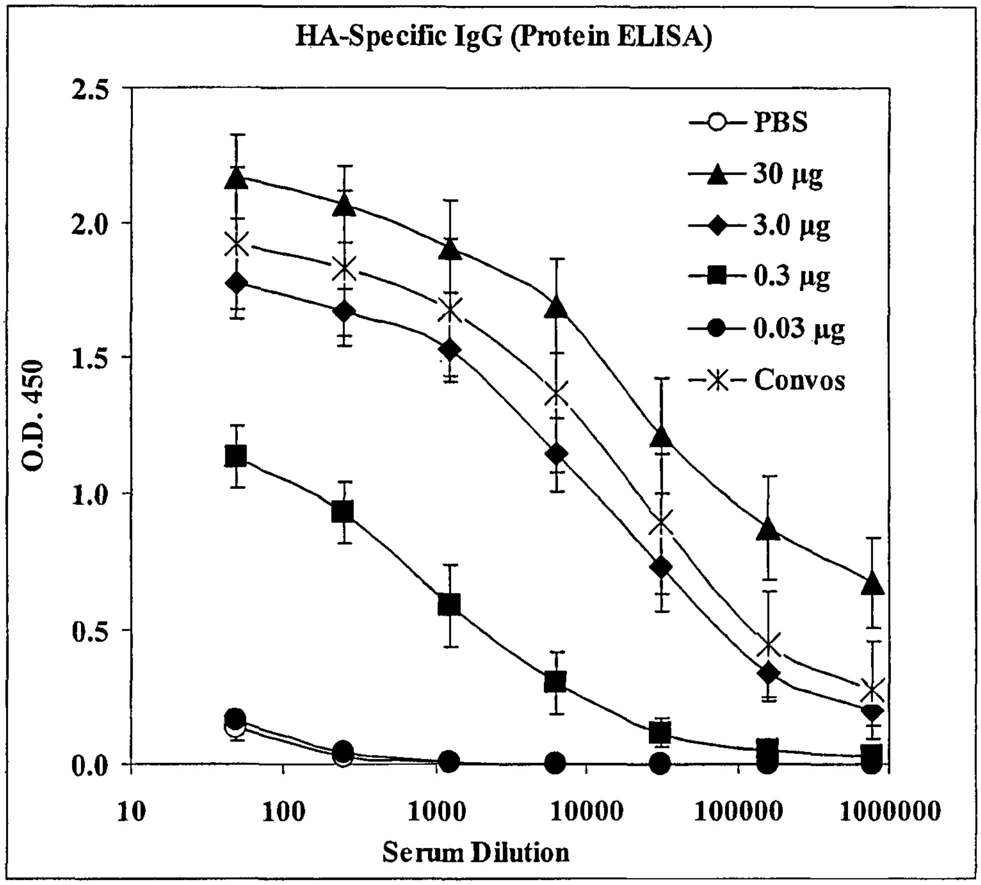
FIG. 6 depicts the dose-dependent antibody response to STF2.HA1-2(PR8) (SEQ ID NO: 90) in BALB/c mice. Mice (10/group) were immunized as indicated on days 0 and 14, and bled on days 12 and 21. Anti-HA IgG responses on Day 28 were examined by ELISA. Convalescent antisera (x) were included as a positive control. The data depict the mean±SD of 10 individual sera per group.

Induction of HA-specific IgG response following immunization with STF2.HA1-2(PR8) (SEQ ID NO: 90): The immunogenicity of STF2.HA1-2 was examined by immunizing BALB/c mice (10/group) subcutaneously on day 0 and 14 with a dose range of STF2.HA1-2 (30, 3.0, 0.3, or 0.03 μg). Control groups of mice were immunized with PBS (negative control), 3 μg of STF2.4×M2e (SEQ ID NO: 94) (negative control for HA immunogenicity, positive control for lethal challenge efficacy study), or a sub-lethal challenge with $8\times10^1$ EID of the influenza isolate PR/8/34 to generate immune convalescent animals. HA-specific IgG responses were examined 7 days post boost (Day 21) by ELISA. The results demonstrate that immunization with 30, 3 or 0.3 μg of STF2.HA1-2(PR8) induced consistent and significant HA0sHis-specific (SEQ ID NO: 176) IgG responses in a dose-dependent manner (FIG. 6).

Figure 7:
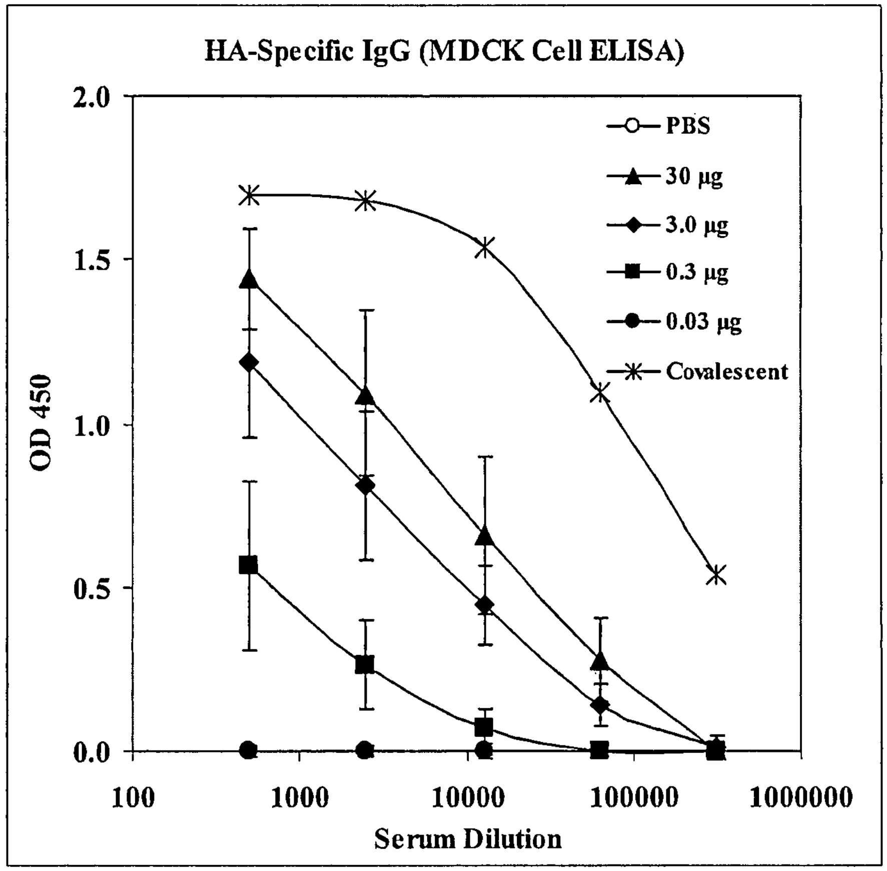
FIG. 7 depicts serum reactivity with influenza infected cells in vitro. The day 21 serum samples depicted in FIG. 6 were incubated with mock- and PR/8/34-infected MDCK cells. The data represent the $OD_{450}$ mean±SD of 10 individual sera/group.

Sera from BALB/c mice immunized with STF2.HA1-2 (SEQ ID NO: 90) react with MDCK cells infected with influenza virus: The direct ELISA results above demonstrated that the immune sera from STF2.HA1-2-immunized animals recognize recombinant *Drosophila* expressed HA0sHis (SEQ ID NO: 176) corresponding to the PR/8/34 HA sequence. In order to demonstrate that the anti-HA antibodies recognize native viral HA, the same sera were examined for the ability to react with MDCK cells infected with PR/8/34. The results shown in FIG. 7 demonstrate that sera from mice immunized with 30, 3.0, or 0.30 μg of STF2.HA1-2 bound specifically to PR/8/34-infected MDCK cells, indicating that the anti-HA antibodies elicited by immunization with STF2.HA1-2 recognize HA in its native conformation.

Collectively these results demonstrate that mice immunized with STF2.HA1-2 (PR8) (SEQ ID NO: 90) in PBS, without conventional adjuvant or carrier, mounted vigorous anti-HA responses that recognized recombinant HA expressed in *Drosophila* and native viral HA expressed on the surface of PR/8/34 infected MDCK cells in vitro.

Example 6

Efficacy of Recombinant Flagellin-Hemagglutinin Fusion Proteins Representing Viral Strain A/Puerto Rico/8/34

Materials and Methods

Influenza virus challenge of mice. To assess efficacy, mice immunized as described in Example 5 were challenged on day 28 by intranasal administration of an $LD_{90}$ (dose lethal to 90% of mice)($8\times10^3$ EID) of influenza A isolate PR/8/34. Animals were monitored daily for 21 days following the challenge for survival, weight loss and clinical presentation. The % weight loss was calculated based on the mean of ((Daily weight (g)/Initial weight (g) day 28)×100) of each individual animal per group. Clinical scores were assigned as follows: 4 pts=healthy, 3 pts=reduced grooming, 2 pts=reduced physical activity and 1 pt=moribund. (Experimental results for clinical scores and weight loss reflect the results based on surviving animals on the day evaluated).

Virus Titration and Determination of $TCID_{50}$.

Cell preparation: MDCK cells (ATCC (Cat#CCL-34), Manassas, Va.) were cultured in 100×20 mm culture plates (BD (Cat#353003) Corning, N.Y.) to 90-95% confluency and the monolayer was dislodged by incubation with trypsin-EDTA at 37° C./5% $CO_2$ for 20 minutes. The trypsin was inactivated by the addition of DMEM cell culture medium supplemented with 10% FBS, and the cell monolayer was scraped with a sterile spatula to complete detachment of cells. The cell suspension was harvested and washed twice with DMEM+10% FBS. Cells were resuspended in DMEM+10% FBS and counted. The cell concentration was adjusted to $4\times10^5$ cells/ml and 100 μl was added to each well of a 96-well tissue culture plate (BD (Cat#353075), Corning N.Y.). Plates were incubated at 37° C./5% $CO_2$ until confluence reached 90-95%.

Viral titration: Influenza virus (strain A/Puerto Rico/8/34 [PR/8]) was diluted to $1\times10^8$ EID in phenol red-free DMEM+0.1% BSA (fractionV (Rockland (Cat#BSA-50) Gilbertsville, Pa.), and serial 5-fold dilutions were prepared in 96-well plates using the same medium. Monolayers of MDCK cells in 96-well plates, prepared as described in herein, were washed by aspirating the culture medium, replacing with 200 μl/well of 1×PBS, and aspirating the PBS. Serial 5-fold dilutions of influenza virus prepared above were added to the washed monolayers in a volume of 100 μl/well. One row of wells was treated with medium only as a control. The cells were incubated for 2 hours at 37° C./5% $CO_2$ to allow viral attachment and entry. Wells were washed by aspiration, rinsing with 200 μl/well PBS, and aspiration of the PBS. All wells received 100 μl/well phenol red-free DMEM+0.1% BSA and the plates are incubated for 48 hours at 37° C./5% $CO_2$.

Determination of cell viability: Following incubation with virus as described above, the medium was aspirated from the wells and replaced with fresh medium containing 40 μg/ml neutral red (Simga Aldrich (Cat#N2889) St. Louis, Mo.). To determine maximum lysis, 211 lysis solution (9% Triton X-100 in water, weight/vol) was added to triplicate wells that were incubated with medium only. Following a one hour incubation, the cells were fixed by the addition of 100 μl/well 1% formaldehyde/1% $CaCl_2$ for 5 minutes at room temperature; this fix step was performed twice in succession. The fix solution was aspirated and the neutral red was released by the addition of 100 μl/well of extraction medium (50% ethanol/1% acetic acid).

The plate was incubated at room temperature for 20 minutes, with shaking for the final 2 minutes. The amount of dye released was determined by measuring absorbance at a wavelength of 540 nm using a microplate spectrophotometer. Cell death (and hence, viral infectivity) was measured as a decrease in the amount of dye released as compared to media control. At the end of the incubation, the neutral red assay was performed as described herein. The percentage lysis of each serum dilution was calculated as:

$$\%\ \text{reduction}=100\times((\text{sample-virus})/(\text{med-virus}))$$

where sample, max, and med refer to the absorbance values in wells representing experimental samples, virus only, and medium only, respectively. The neutralizing titer of each sample was defined as the dilution of serum which resulted in a 50% reduction in viral infectivity.

Influenza A/PR/8/34 Neutralization Assay This assay was adapted with modifications from WHO Manual on Animal Influenza Diagnosis and Surveillance, p. 86-88 (WHO/CDS/CSR/NCS2002.5). The Neutral Red Assay is adapted from a public protocol of the Cell Lab at Gettysburg College.

Specifically, MDCK (ATCC, Cat#(CCL_34), Manassas, Va.) cells were plated in 96-well tissue culture plates (BD (Cat 353075), Corning, N.Y.) as described above. Test reagents (experimental and control sera) were heat-inactivated by incubating for 30 minutes in a water bath heated to 56° C. Sera were serially titrated in 96-well plates, in 3-fold dilutions in phenol red-free DMEM+0.1% BSA. An equal volume of PR/8/34 virus diluted to $5\times10^6$/ml EID in the same medium was added to each serum dilution to achieve a final viral concentration of $2.5\times10^6$ EID/ml (The pre-determined $TCID_{50}$ for our current stock of virus). Wells containing medium only and virus only were included as negative and positive controls, respectively. The plates were incubated for 30 minutes at 37° C./5% $CO_2$.

Figure 8A:
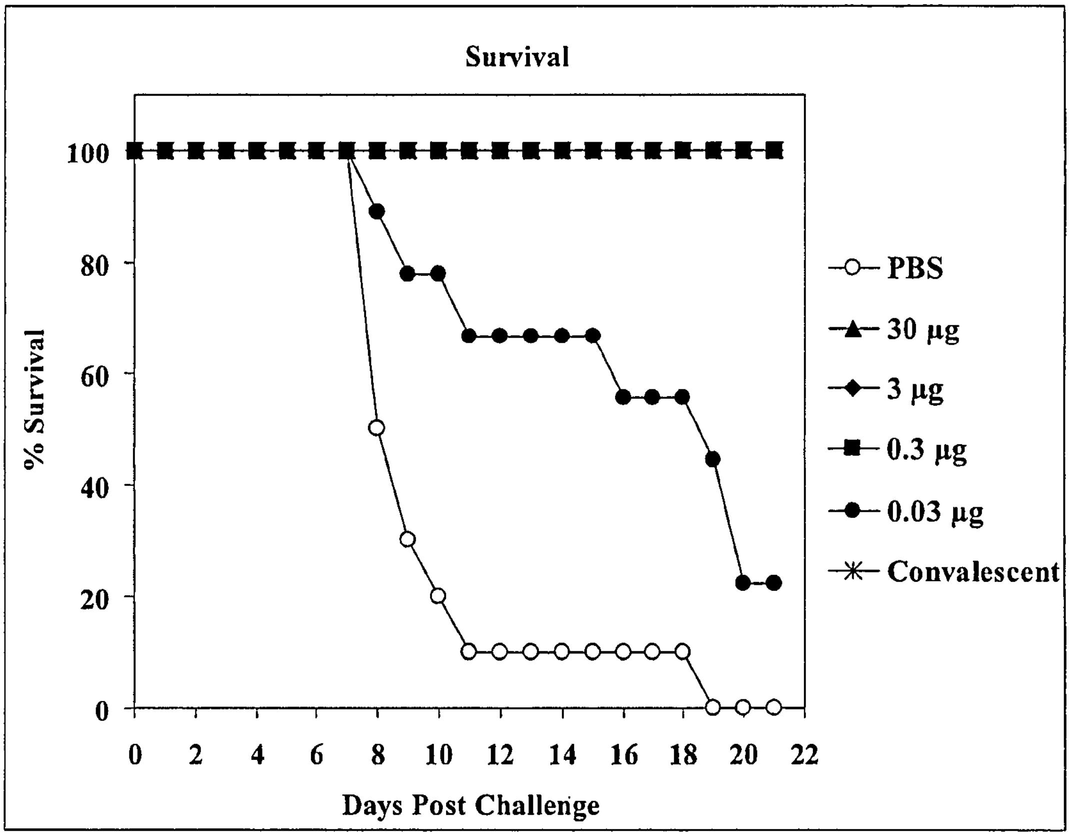
FIG. 8A depicts survival of BALB/c mice immunized with STF2.HA1-2(PR8) (SEQ ID NO: 90). Mice from FIGS. 8 and 9 were challenged on day 28 with an $LD_{90}$ ($8\times10^3$ EID) of influenza A PR/8/34 administered intranasally (Day 0 post-challenge).
Figure 8B:
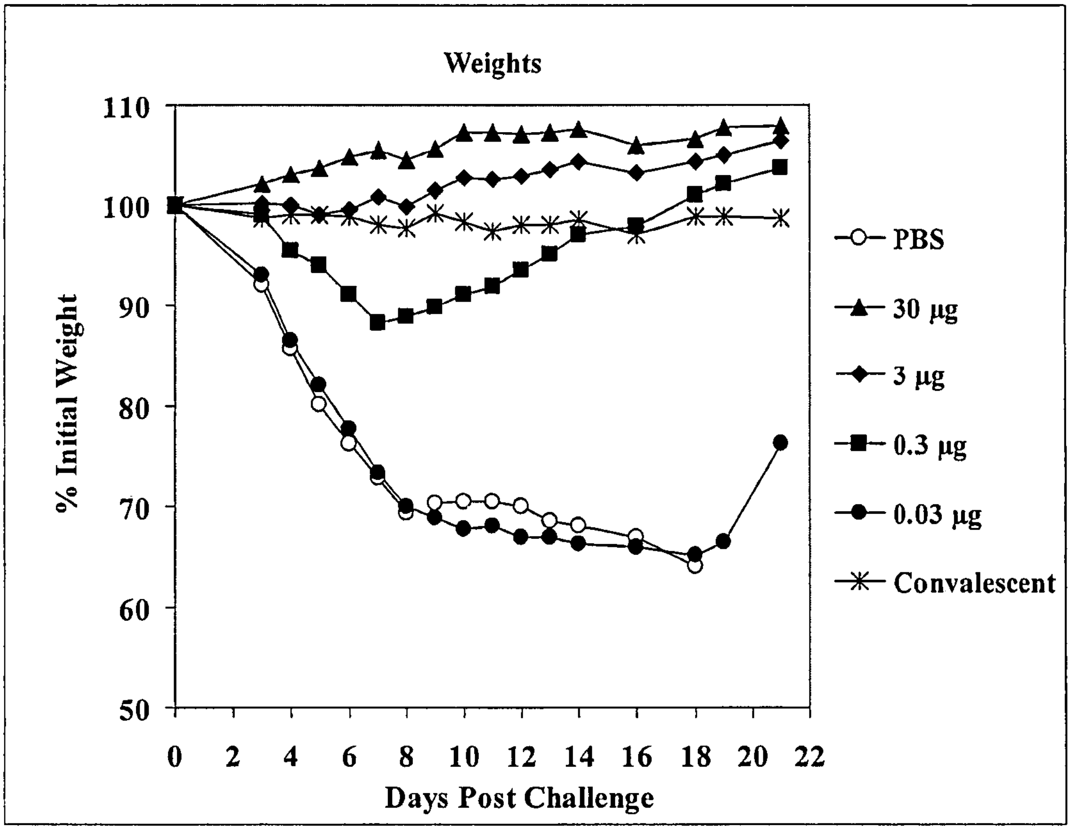
FIG. 8B depicts weights of BALB/c mice immunized with STF2.HA1-2(PR8) (SEQ ID NO: 90). Mice from FIGS. 6 and 7 were challenged on day 28 with an $LD_{90}$ ($8\times10^3$ EID) of influenza A PR/8/34 administered intranasally (Day 0 post-challenge). Graph reflects the average weight per group based on individual animals measured daily for 19 days.
Figure 8C:
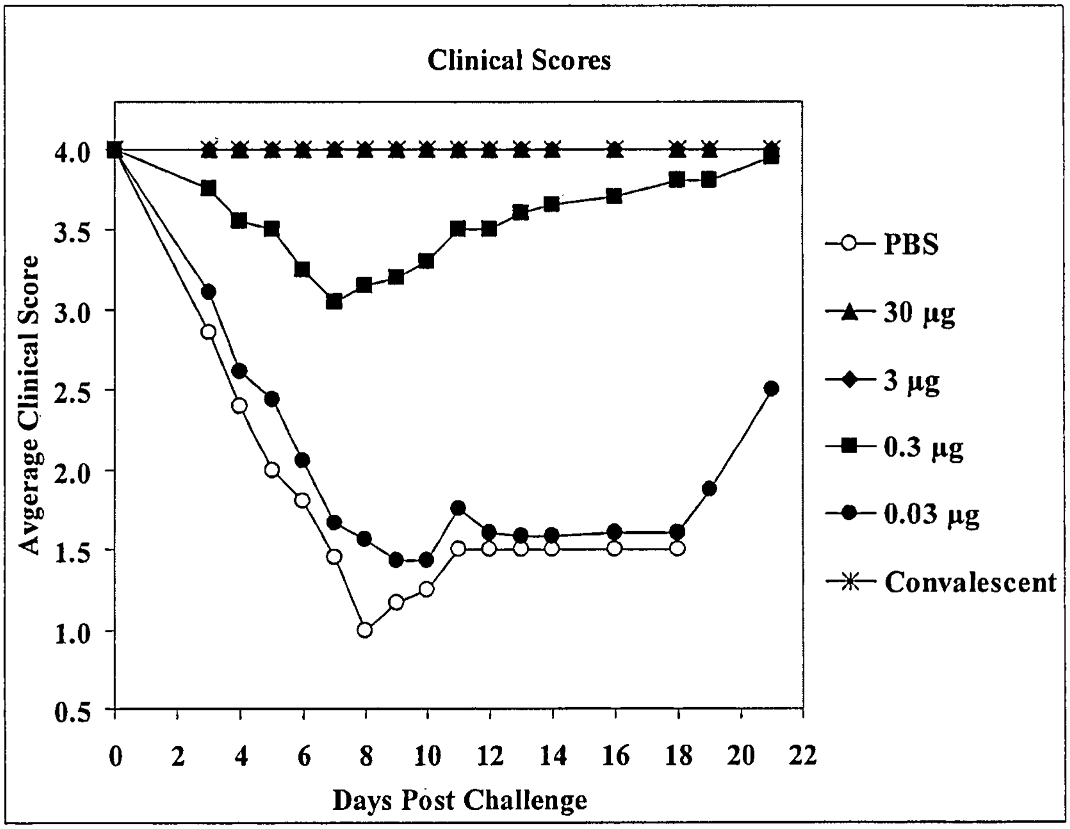
FIG. 8C depicts clinical Score of BALB/c mice immunized with STF2.HA1-2(PR8) (SEQ ID: NO 90). Mice from FIGS. 6 and 7 were challenged on day 28 with an $LD_{90}$ ($8\times10^3$ EID) of influenza A PR/8/34 administered intranasally (Day 0 post-challenge). Graph reflects the average clinical score per group based on individual animals measured daily for 19 days. Clinical scores were assessed as follows: 4 pts=healthy, 3 pts=reduced grooming, 2 pts=reduced physical activity and 1 pt moribund.

Cell monolayers prepared as described above (Cell preparation) were washed once with 200 μl/well 1×PBS, then 100 μl/well of serum:virus mixtures and control reagents prepared as described above were added and incubated for 2 hours at 37° C./5% $CO_2$. Following incubation, cell monolayers were washed once with PBS, and 100 μl/well phenol red-free DMEM+0.1% BSA was added to each well and incubated at 37° C./5% $CO_2$ for 48 hours. At the end of the incubation, the neutral red assay was performed as described above (Determination of cell viability). The percentage lysis of each serum dilution was calculated as described above. The neutralizing titer of each sample was defined as the dilution of serum which results in a 50% reduction in viral infectivity Results and Discussion Immunization with STF2.HA1-2(PR8) (SEQ ID NO: 90) provides protection from a lethal challenge with influenza A: The results from Example 5 demonstrated that immunization of mice with STF2.HA1-2(PR8) (SEQ ID NO: 90) generated an antibody response that recognized native HA. In order to evaluate efficacy, the same mice were challenged on day 28 with an $LD_{90}$ ($8\times10^3$EID) of PR/8/34 virus administered intra-nasally. Mice were monitored daily for 19 days following the challenge for survival, weight loss and clinical presentation. As shown in FIGS. 8A, 8B, and 8C, PBS-immunized mice showed signs of infection (weight loss and lower clinical scores) as early as three days post-challenge and all mice died by day 21 post-challenge. In contrast, mice immunized with 30, 3.0 or 0.3 μg of STF2.HA1-2(PR8) (SEQ ID NO: 90) demonstrated markedly enhanced protection. These animals demonstrated little to no weight loss, significantly higher clinical scores and 100% survival that was similar to immune convalescent control animals over the 21 day period. These results demonstrate that *E. coli*-expressed STF2.HA1-2(PR8) (SEQ ID NO: 90) induces HA-specific immune responses that successfully protect BALB/c mice from a lethal challenge with virulent influenza A virus in vivo.

Figure 9:
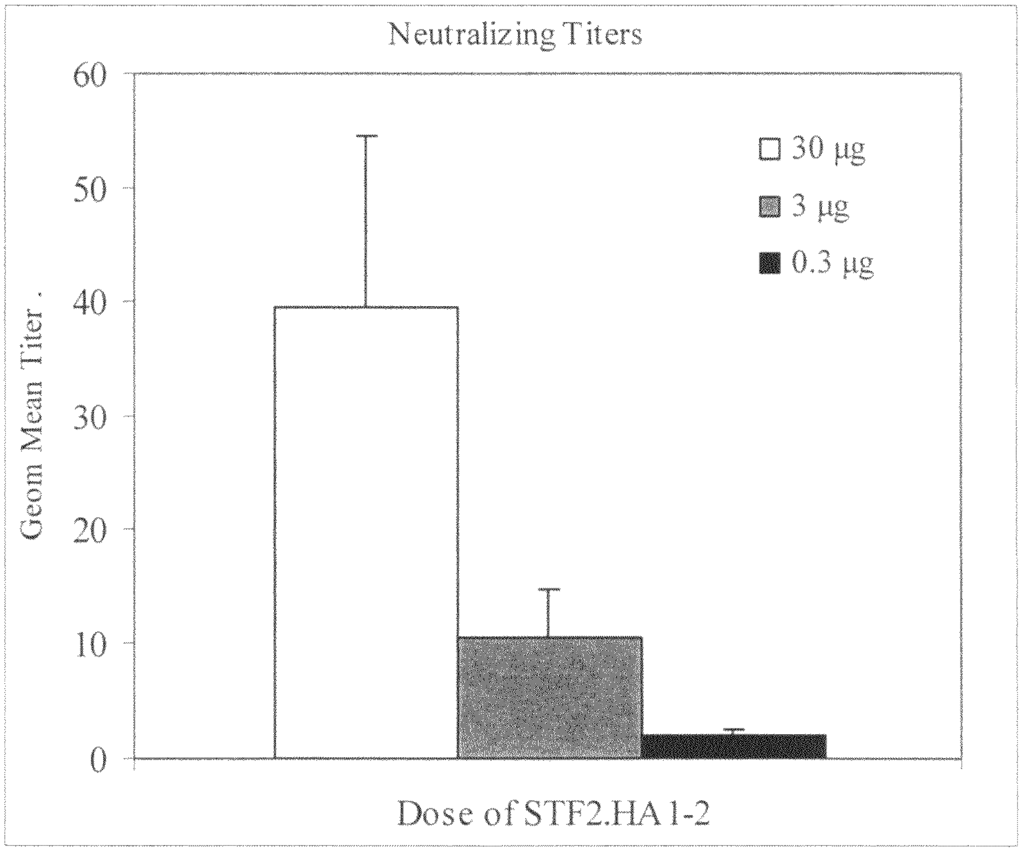
FIG. 9 depicts neutralization activity of immune sera from BALB/c mice immunized with the indicated doses of STF2.HA1-2(PR8) (SEQ ID NO: 90) on days 0 and 14, and bled on day 21. The endpoint titer of each sample was calculated as the titer that inhibited virus-mediated lysis of the cells by at least 50%. Geometric mean titers±SD were calculated for each dose group and plotted.

In order to evaluate the effectiveness of the antibody response in vitro a cell-based virus neutralization assay was developed to test the ability of immune sera to neutralize viral infectivity. In this study the viral inhibitory activity of serum from animals immunized with STF2.HA1-2(PR8) (SEQ ID NO: 90) and STF2.HA1-1(PR8) (SEQ ID NO: 151) was examined. Serial dilutions of non-immune and immune sera were pre-incubated with PR/8 and incubated with MDCK cells. Wells were washed to remove free virus and plates were incubated prior to staining with neutral red to detect live cells. The results indicate that immune sera from animals immunized with STF2.HA1-2(PR8) (SEQ ID NO: 90) demonstrated a tissue culture inhibition 50% dose (TCID) of >1:40 (FIG. 9).

Example 7

Immunogenicity of Recombinant Flagellin-Hemagglutinin Fusion Proteins Representing Viral Strain A/Viet Nam/1203/2004

Materials and Methods

Animal studies: Female BALB/c mice (Jackson Laboratory, Bar Harbor, Me.) were used at the age of 6-8 weeks. Mice were divided into groups of 10 and received inguinal s.c immunizations on days 0 and 14 as follows:

1) PBS (phosphate buffered saline).
2) 3.0 μg of STF2.HA1-2(PR8) (SEQ ID NO: 90) in PBS
3) 3.0 μg of STF2.HA1-2(VN) (SEQ ID NO: 95) in PBS
4) 0.3 μg of STF2.HA1-2(VN) (SEQ ID NO: 95) in PBS Mice were bled on day 21 and sera were clarified by clotting and centrifugation and stored at −20° C.

Serum antibody determination: HA and STF2-specific IgG levels were determined by ELISA. 96-well ELISA plates (Costar (Cat#9018), Corning, N.Y.) were coated overnight at 4° C. with 100 μl/well of HA protein purified from Viet Nam/1203/2004 (BEI Resources (Cat #NR-660), Manassas, Va.)) or recombinant flagellin (STF2) (SEQ ID NO: 96) in PBS (5 μg/ml). Plates were blocked with 200 μl/well of Assay Diluent Buffer (ADB; BD Pharmingen (Cat#555213) San Diego, Calif.) for one hour at room temperature. The plates were washed three times in PBS buffer containing 0.05% (v/v) Tween 20 (PBS-T). Dilutions of the sera in ADB were added (100 μl/well) and the plates were incubated overnight at 4° C. The plates were washed three times with PBS-T. HRP-labeled goat anti-mouse IgG antibodies (Jackson Immunochemical (Cat#115-035-146), West Grove, Pa.) diluted in ADB were added (100 μl/well) and the plates were incubated at room temperature for 1 hour. The plates were washed three times with PBS-T. After adding TMB Ultra substrate (Pierce (Cat#34028), Rockford, Ill.)) and monitoring color development, $A_{450}$ was measured on a Tecan Farcyte (Durham, N.C.) microplate spectrophotometer.

Results and Discussion

Figure 10A:
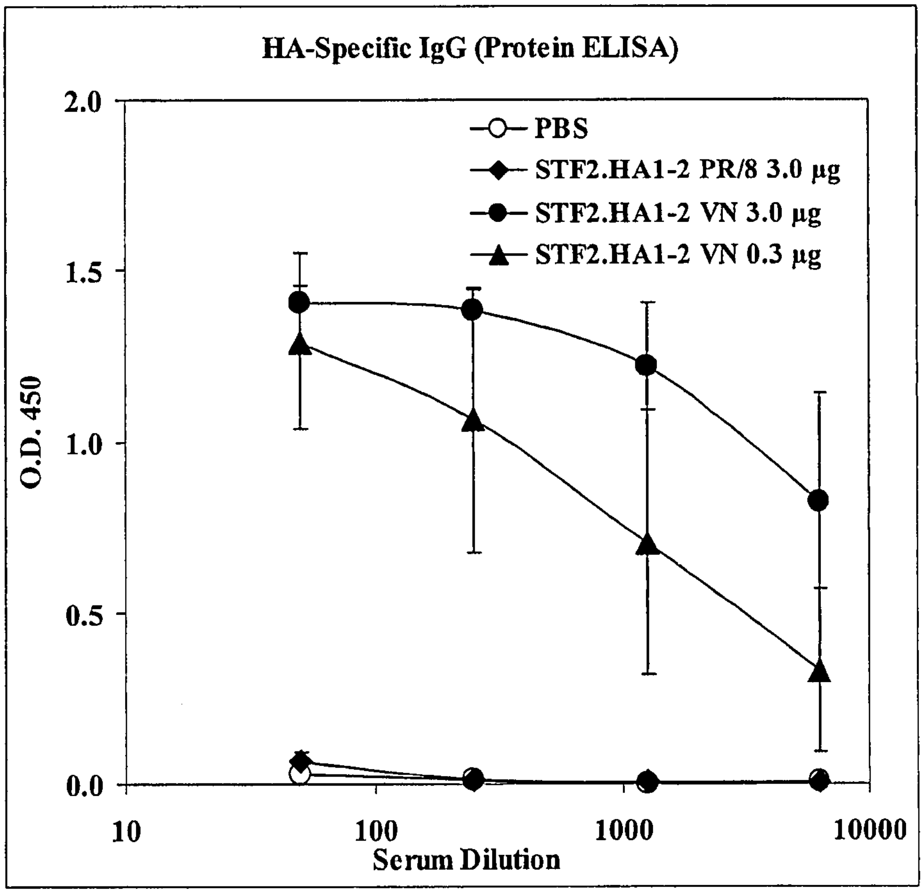
FIGS. 10A and 10B depict anti-HA antibody response of BALB/c mice immunized with 3 μg of STF2.HA1-2(PR8) (SEQ ID NO: 90), or 3 or 0.3 μg of STF2.HA1-2(VN) (SEQ ID NO: 95) s.c. on days 0 and 14. On day 21, sera were isolated and examined for reactivity with (FIG. 10A) HA purified from Influenza A/Viet Nam/1203/2004 (obtained from BEI Resources Cat#NR-660)) and (FIG. 10B) recombinant flagellin (STF2) (SEQ ID NO: 96) by ELISA.
Figure 10B:
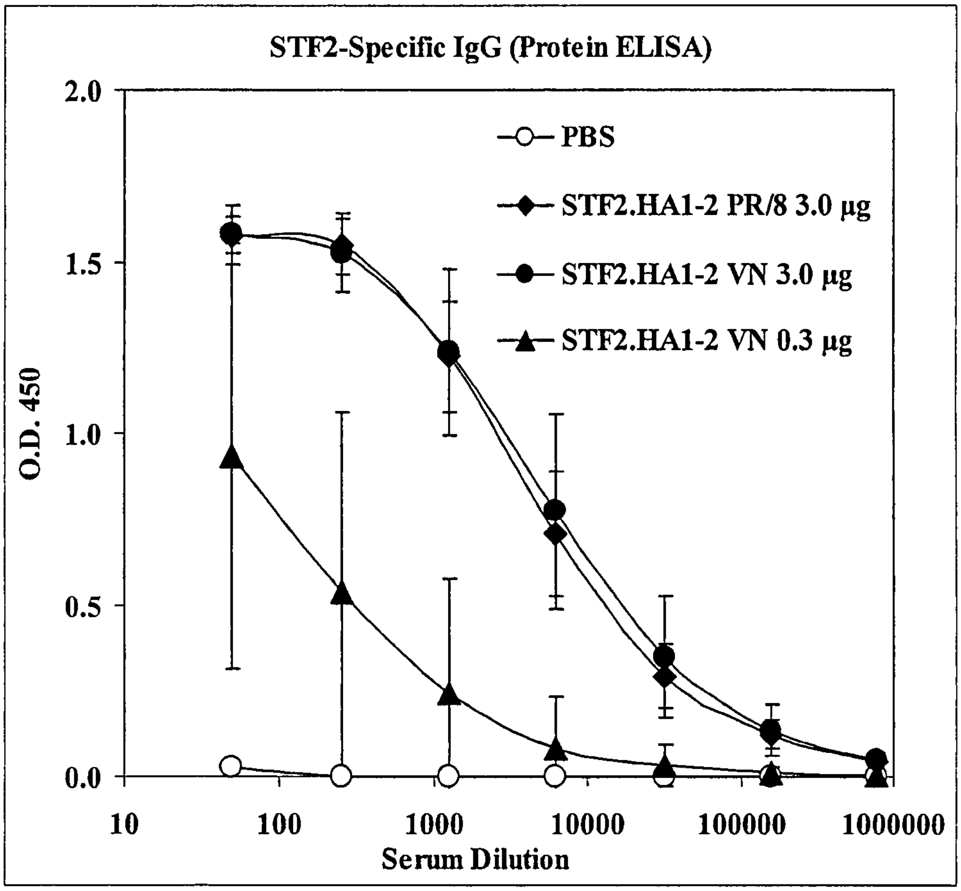

The immunogenicity of STF2.HA1-2(VN) (SEQ ID NO: 95) was examined in BALB/c mice. Animals were immunized s.c. on days 0 and 14 with 3 μg STF2.HA1-2(PR8) (SEQ ID NO: 90), or 3 or 0.3 μg of STF2.HA1-2(VN) (SEQ ID NO: 95). On day 21 animals were bled and serum IgG responses to purified HA from A/Viet Nam/1203/2004 (obtained from BEI Resousrces Cat#NR-660) and recombinant flagellin (STF2; (SEQ ID NO: 96)) were examined by ELISA (FIGS. 10A and 10B). The results demonstrate that serum from mice immunized with STF2.HA1-2(VN) (SEQ ID NO: 95) exhibit antigen-specific reactivity with purified H5 protein from influenza A/Viet Nam/1203/2004.

Example 8

Cloning, Expression, and Biochemical Characterization of Recombinant Flagellin-Hemagglutinin Fusion Proteins Produced in *Baculovirus*

Figure 11:
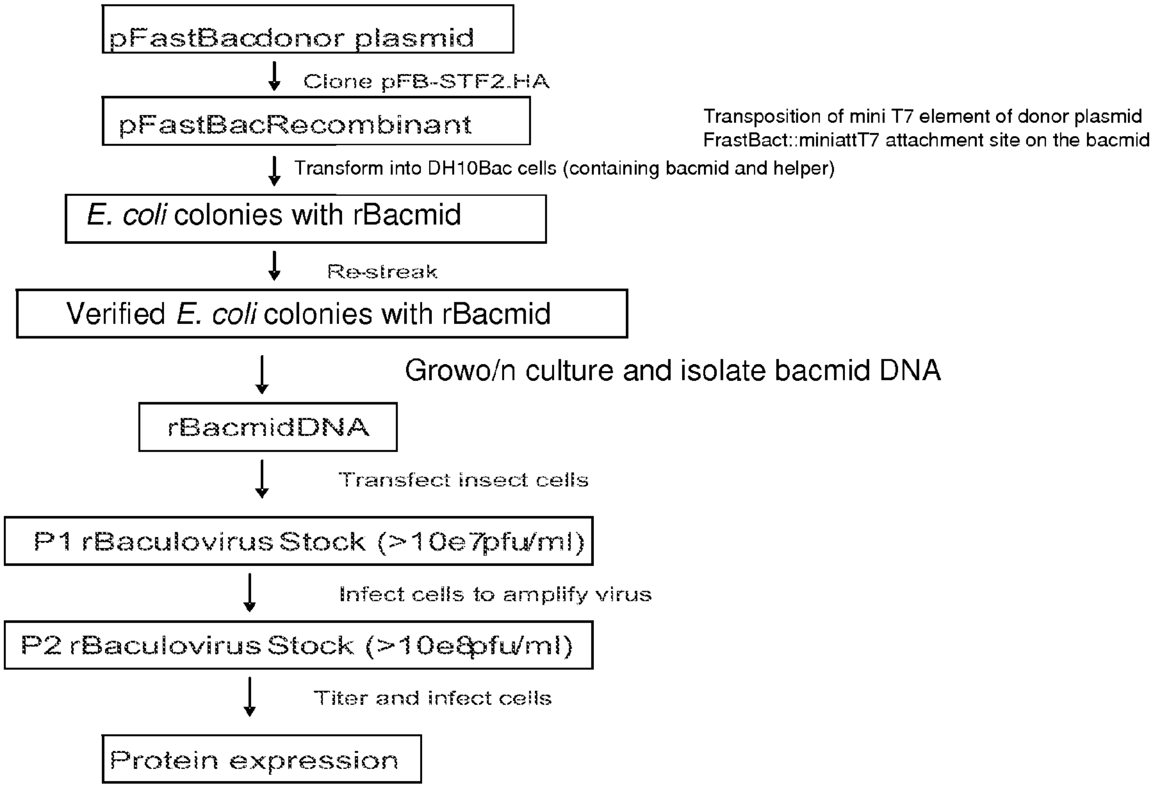
FIG. 11 depicts a flow chart of the steps required to express pFastBac constructs using Bac-to-Bac *Baculovirus* Expression system.

Cloning: Expression of HA and STF2.HA fusion proteins was carried out using the Bac-to-Bac *Baculovirus* Expression System (Invitrogen, Carlsbad, Calif.) according to the manufacturer's guidelines (FIG. 11). cDNAs encoding HA and STF2.HA fusion proteins were cloned into the pFastBac donor plasmid which was then used to transform DH10Bac cells containing the bacmid and helper DNA. Recombinant bacmid clones generated by homologous recombination in DH10Bac were then identified by blue-white screening on X-gal plates. The details of the cloning procedure are given in the following paragraphs.

Generation of vector cassettes: The pFastBac™1 vector is compatible with the Bac-to-Bac® *Baculovirus* Expression System (Invitrogen, Carlsbad, Calif.). This vector has a strong AcMNPV polyhedrin (PH) promoter for high level protein expression and a large multiple cloning site for simplified cloning. pFastBac™1 is a non-fusion vector (i.e. no fusion tags are present in the vector).

To ensure proper expression of recombinant protein, the insert must contain an ATG start codon for initiation of translation and a stop codon for termination of translation. In order to facilitate cloning of flagellin in fusion with several truncations of the HA gene, two plasmid cassettes were engineered: pFB-STF2Blp.wt (SEQ ID NO: 97) and pFB-STF2Blp.ng (SEQ ID NO: 98). In the latter, the putative glycosylation sites in the flagellin (STF2) gene were obliterated by substituting Gln (Q) for Asn (N). Potential glycosylation sites were determined using the consensus sequence for N-glycosylation N-X-S/T: N residue followed by any residue by S or T in the third position.

In the certain locations, residues 40, 122, 215, 237, 414, 478, and 497 of the STF2 gene (SEQ ID NO: 212) the N residue was incorporated as a Q substitution. Constructs which harbor these mutations and in which the proteins are not likely to be modified by sugars are designated as non-glycosylated (ng) mutants. Similarly, glycosylation mutations were introduced in HA0s gene at positions 11, 23, 268, 286 and 480 (SEQ ID NO: 23). Both vector constructs (pFB-STF2Blp.wt and pFB-STF2Blp.ng) harbor a silent mutation at nucleotides 5'-GTGCTGAGCCTGTTACGT-3' (SEQ ID NO: 310) (nt 1501 to 1518) of STF2 (SEQ ID NO: 212) creating a unique BlpI in the plasmid cassette. Each cassette contains the honey bee melittin (HBM) sequence (SEQ ID NO: 99) fused at the amino terminus of STF2 to provide a signal for secretion. Both plasmids were codon-optimized for expression in B *Baculovirus* (Midland Certified Reagent Co., Inc, Midland, Tex.; DNA2.0 Inc, Menlo Park, Calif.). The synthetic genes were excised with BamHI or BglII and SphI and cloned into pFastBac™1 vector by compatible end ligation generating the pFB-STF2Blp.wt and pFB-STF2Blp.ng cassettes.

Flagellin-HA fusion constructs: Subunits of the HA globular head from influenza strains A/Puerto Rico/8/34, A/Viet Nam/1203/2004, A/Indonesia/2005 and A/New Caledonia/12/99 were expressed alone or genetically fused to flagellin (STF2) (SEQ ID NO: 178) and expressed in *Baculovirus*. This was accomplished by one of three methods.

Method #1: To generate reagents for ELISA, HA1-1 subunits of PR8, VN, IND and NC strains (Tables 7 and 8) were cloned into pFastBac™1, generating pFB.HA1-1 that harbors a hexa-his tag. This was achieved by employing PCR with a set of primers as indicated in the Tables below and with a synthetic codon-optimized HA0s gene (HA excluding the signal sequence and extracellular domain) as DNA template (DNA2.0 Inc., Menlo Park, Calif.). The PCR fragments were digested with BglII and SphI and inserted into pFastBac™1 that has previously been treated with BglII and SphI enzymes followed by BAP treatment. In order to generate a flagellin-HA subunit fusion, the PCR product was digested with BlpI, and ligated by compatible ends to pFB-STF2Blp.wt.

Method #2: In this protocol, codon-optimized HA subunit genes representing both the wt and non-glycosylated forms were chemically synthesized (DNA2.0 Inc., Menlo Park, Calif.). The genes were excised with BlpI and SphI enzymes and the fragment gel purified and ligated to pFB-STF2Blp.wt or the non-glycosylated version, pFB-STF2Blp.ng previously digested with BlpI and SphI and BAP treated. In each case, the ligation mix was used to transform TOP 10 cells and transformants were screened by PCR and DNA sequencing to confirm the presence and correct orientation of the inserts. The constructs were used to transform MAX Efficiency® DH10Bac™ competent *E. coli* (Invitrogen, Carlsbad, Calif.) to generate a recombinant bacmid. The colonies of bacteria were screened for positive bacmids by blue/white selection on plates containing 50 μg/mL kanamycin, 7 μg/mL gentamycin, 10 μg/mL tetracycline, 40 μg/mL IPTG and Bluo-Gal (40 μg/mL). Recombinant bacmid DNA was prepared and used to transfect the insect cell line of choice (Sf9 or Sf21 cells) to generate a recombinant *Baculovirus*. The baculoviral stock was then amplified and titered and used to infect High Five insect cells to express the recombinant protein.

TABLE 7

PR8 HA constructs for expression in Baculovirus

| SEQ ID NO: | Construct (His tag) | Method | FOR Primer SEQ ID NO: | REV Primer SEQ ID NO: | DNA Template SEQ ID NO: |
|---|---|---|---|---|---|
| 100 | STF2.1-HA0s | #1 | 101 | 102 | 103 |
| 104 | STF2.HA1-1 | #1 | 105 | 106 | 103 |
| 107 | STF2.HA1-2 | #1 | 108 | 109 | 103 |
| 110 | STF2.HA1-2mut | #2 | N/A | N/A | 111 |
| 112 | STF2.HA1-3 | #1 | 113 | 114 | 103 |
| 115 | STF2.HA1-3mut | #2 | N/A | N/A | 116 |
| 117 | ngSTF2.HA0s | #2 | N/A | N/A | 118 |
| 119 | ngSTF2.HA1-1 | #2 | N/A | N/A | 120 |
| 121 | ngSTF2.HA1-2 | #2 | N/A | N/A | 122 |
| 123 | ngSTF2.HA1-2mut | #2 | N/A | N/A | 124 |
| 125 | ngSTF2.HA1-3 | #2 | N/A | N/A | 126 |
| 127 | ngSTF2.HA1-3mut | #2 | N/A | N/A | 128 |
| 129 | wtSTF2.HA1-1ng | #2 | N/A | N/A | 130 |
| 131 | ngSTF2.HA1-1wt | #2 | N/A | N/A | 132 |
| 133 | HA1-1 | #1 | 134 | 135 | 136 |
| 137 | HA1-1 (no tag) | #1 | 134 | 138 | 136 |

TABLE 8

NC, VN and NC HA constructs for expression in Baculovirus

| SEQ ID NO: | Construct (his tag) | Method | FOR Primer SEQ ID NO: | REV Primer SEQ ID NO: | DNA Temlate SEQ ID NO: |
|---|---|---|---|---|---|
| 139 | HA1-1(NC) | #1 | 140 | 141 | 142 |
| 143 | HA1-1(VN) | #1 | 144 | 145 | 146 |
| 147 | HA1-1(IND) | #1 | 148 | 149 | 150 |

Protein Expression: *Spodoptera frugiperda* (Sf9) insect cells were cultured in Grace's Insect Cell Medium (Invitrogen; Carlsbad, Calif.). Recombinant bacmids were purified from DH10Bac clones and transfected into Sf9 cells using Cellfectin (Invitrogen; Carlsbad, Calif.) to generate passage one (P1) *Baculovirus* stocks which were then titered by traditional plaque assay according to the manufacturer's guidelines. Subsequent infections of Sf9 cells were performed using P1 viral stocks at a multiplicity of infection (MOI) of 0.1 to produce larger volume P2 viral stocks with increased viral titers. Cultures expressing the following proteins were scaled up for protein purification: ngSTF2.HA(PR8)1-2mutHis (SEQ ID NO: 156); ngSTF2.HA(PR8)1-1His (SEQ ID NO: 152; STF2.HA(PR8)1-1His (SEQ ID NO: 151); STF2.HA(PR8)1-2His (SEQ ID NO: 153); STF2.HA1-2mutHis (SEQ ID NO: 155); HA(PR8)1-1His (SEQ ID NO: 179) HA(VN)1-1His (SEQ ID NO: 180); HA(IND)1-1His (SEQ ID NO: 181); HA(NC)1-1His (SEQ ID NO: 182). Protein expression was performed by infecting 2×1 L flasks of High-5 insect cells with P2 virus at an MOI of 2 and culturing for 24 hrs at 28° C. with slow shaking. Conditioned medium was harvested by centrifugation and clarified by passing through a 0.22 μm filter and stored at 4° C.

Protein Purification: $NiSO_4$ was added to each clarified supernatant to a final concentration of 0.5 mM and the pH adjusted to 8.0. The $His_6$-tagged protein was then captured on a chelating sepharose column (GE/Amersham Biosciences; Piscataway, N.J.) charged with $NiSO_4$ and equilibrated in Buffer A (20 mM Tris, pH 8.0, 0.5 M NaCl). After washing with Buffer A the bound protein was eluted with Buffer B (Buffer A+0.5 M imidazole). Peak fractions were pooled, dialyzed overnight into Buffer A and applied to a nickel NTA column (Sigma-Aldrich; St. Louis, Mo.). The column was eluted with a 5-column volume gradient from 100% Buffer A to 100% Buffer B. Peak fractions were pooled and dialyzed into 1×TBS, pH 8.0.

SDS-PAGE and western blot analysis: Protein identity was determined, and purity estimated, by SDS-PAGE. An aliquot of 5 μg of each sample was diluted in SDS-PAGE sample buffer with or without 100 mM DTT as a reductant. The samples were boiled for 5 minutes and loaded onto a 10% SDS polyacrylamide gel (LifeGels; French's Forrest, New South Wales, AUS) and electrophoresed. The gel was stained with Coomassie R-250 (Bio-Rad; Hercules, Calif.) to visualize protein bands. For western blot, 0.5 μg/lane total protein was electrophoresed as described above and the gels were then electro-transferred to a PVDF membrane and blocked with 5% (w/v) dry milk before probing with anti-flagellin antibody (Inotek; Beverly, Mass.), anti-$His_6$ antibody (Invitrogen; Carlsbad, Calif.), or influenza A PR/8/34 convalescent immune serum (described below under Protein Antigenicity ELISA). After probing with alkaline phosphatase-conjugated secondary antibodies (Pierce; Rockford, Ill.), protein bands were visualized with an alkaline phosphatase chromogenic substrate (Promega; Madison, Wis.).

Protein assay: Total protein concentration was determined using the Micro BCA (bicinchoninic acid) Assay (Pierce; Rockford, Ill.) in the microplate format, using bovine serum albumin as a standard, according to the manufacturer's instructions.

Endotoxin assay: Endotoxin levels were determined using the QCL-1000 Quantitative Chromogenic LAL test kit (Cambrex; E. Rutherford, N.J.), following the manufacturer's instructions for the microplate method.

TLR5 bioactivity assay: HEK293 cells constitutively express TLR5, and secrete several soluble factors, including IL-8, in response to TLR5 signaling. Cells were seeded in 96-well microplates (50,000 cells/well), and the following test proteins were added and incubated overnight: ngSTF2.HA(PR8)1-2mutHis (SEQ ID NO: 156); ngSTF2.HA(PR8)1-1His (SEQ ID NO: 152); STF2.HA (PR8)1-1His (SEQ ID NO: 151); STF2.HA(PR8)1-2His (SEQ ID NO: 153); STF2.HA1-2(PR8)mutHis (SEQ ID NO: 155) The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockford, Ill., #M801E and #M802B) following the manufacturer's instructions.

Protein antigenicity ELISA: The following constructs purified from *Baculovirus* culture were evaluated by ELISA to determine whether the proteins displayed correctly folded epitopes of HA: ngSTF2.HA(PR8)1-2mutHis (SEQ ID NO: 156); ngSTF2.HA(PR8)1-1His (SEQ ID NO: 152); STF2.HA(PR8)1-1His (SEQ ID NO: 151); STF2.HA(PR8) 1-2His (SEQ ID NO: 153); STF2.HA1-2mutHis (SEQ ID NO: 155); and HA(PR8)1-1His (SEQ ID NO: 179). 96-well ELISA plates were coated overnight at 4° C. with serial dilutions in PBS (100 μl/well) of each target protein starting at 5 μg/ml. Plates were blocked with 200 μl/well of Assay Diluent Buffer (ADB; BD Pharmingen) for one hour at room temperature, then washed three times in PBS-T. A fixed dose of primary antibody was then added to each well. To assay HA reactivity, 100 μl/well of a 1:10,000 dilution of non-immune or PR/8/34 convalescent immune serum in ADB was added. PR/8/34 immune serum was generated in BALB/c mice (Jackson Laboratory, Bar Harbor, Me.) that received an experimentally determined sublethal challenge dose of 8×10 egg infectious dosages (EID) of PR/8/34 influenza virus. Animals were then allowed to convalesce for >21 days post-infection at which time immune serum was isolated and clarified.

For ELISA of flagellin or the 6× histidine tag, monoclonal antibody against 6×His (Invitrogen; Carlsbad, Calif.), or flagellin (Inotek; Beverly, Mass.) was added at 1 μg/ml in ADB (100 μl/well) and the plates were incubated for 1 hr at room temperature or overnight at 4° C. The plates were then washed three times with PBS-T. HRP-labeled goat anti-mouse IgG antibodies (Jackson Immunochemical; West Grove, Pa.) diluted in ADB were added (100 μl/well) and the plates were incubated at room temperature for 1 hour. The plates were washed three times with PBS-T. After adding TMB Ultra substrate (Pierce; Rockford, Ill.) and monitoring color development, $A_{450}$ was measured on a microplate spectrophotometer (FARCyte, GE/Amersham; Piscataway, N.J.).

Results and Discussion

Expression and purification of recombinant HA proteins: The results of *Baculovirus* expression of recombinant STF2.HA fusion proteins are summarized in Table 9. All proteins were expressed in moderate to high yield. Purity after metal chelate chromatography was generally good and endotoxin levels were far below the acceptable limit of 0.1 EU/μg. All STF2 fusion proteins demonstrated potent in vitro TLR5 activity.

TABLE 9

| Protein | SEQ ID NO: | Yield (mg) | Purity est. (%) | Endotoxin (EU/μg) | TLR activity ($EC_{50}$, ng/ml) |
|---|---|---|---|---|---|
| STF2.HA1-1His(PR8) | 151 | 12 | >80 | 0.01 | 3 |
| ngSTF2.HA1-1His(PR8) | 152 | 24 | >90 | <0.01 | 30 |
| STF2.HA1-2His(PR8) | 153 | 13.2 | >90 | <0.01 | 9 |
| STF2.HA1-2mutHis(PR8) | 155 | 25 | >95 | <0.01 | 900 |
| ngSTF2.HA1-2mutHis(PR8) | 156 | 6 | >90 | 0.01 | 9 |

STF2.HA proteins for *Baculovirus* expression were engineered with and without N-linked glycosylation sites in order to determine the effect of this posttranslational modification on protein expression, folding, and biological activity. ngSTF2.HA1-2.mutHis(PR8) (SEQ ID NO: 156), which is non-glycosylated, appears to be expressed at a lower level in *Baculovirus* supernatants than the corresponding glycosylated protein, suggesting that glycosylation may influence the folding or secretion of this protein. However, the glycosylated and non-glycosylated versions of this protein appear to react equally with convalescent antiserum from influenza PR8-infected mice when analyzed by western blot. Furthermore, ngSTF2.HA1-1His(PR8) (SEQ ID NO: 152) expressed at higher levels than its glycosylated counterpart, indicating that any effect of glycosylation on expression of these proteins may not be easily generalized.

In addition to the proteins expressed and purified at large scale, small-scale *Baculovirus* P1 supernatants of STF2.HA1-3His(PR8) (SEQ ID NO: 157) and STF2.HA1-3mutHis(PR8) (SEQ ID NO: 158) were analyzed for HA antibody reactivity. As seen with the STF2.HA1-3(PR8) protein (SEQ ID NO: 92) expressed in *E. coli* (See Example #4), these proteins showed very poor reactivity with PR8 convalescent mouse serum on western blots of conditioned medium. This result further confirms that STF2.HA1-3 proteins, whether expressed in a prokaryotic or eukaryotic host, are unable to fold properly and display native epitopes.

Antigenicity: Several STF2.HA proteins produced in *Baculovirus* and *E. coli* were analyzed by ELISA. All STF2 fusion proteins reacted equally well with anti-flagellin antibody (Inotek; Beverly, Mass.), demonstrating equal protein loading in the assay. Proper folding and display of antibody epitopes in STF2.HA fusion proteins was then examined by measuring reactivity of each protein with antisera from mice which had recovered from PR/8/34 influenza infection. Reactivity with PR/8/34 convalescent mouse serum was equivalent for *Baculovirus*-expressed STF2.HA1-1His(PR8) (SEQ ID NO: 151), ngSTF2.HA1-1His(PR8) (SEQ ID NO: 152), and ngSTF2HA1-2mutHis(PR8) (SEQ ID NO: 156), and *E. coli*-expressed STF2.HA1-2(PR8) (SEQ ID NO: 90) (see Example #4). Thus, serum antibody recognition of the HA head domain may be focused on a region encompassed by the HA1-2 construct. Further, in vitro refolding of STF2.HA1-2 (SEQ ID NO: 90) produced in *E. coli* results in a protein with equivalent immune reactivity (and therefore similar folded conformation) to a protein processed and secreted from a eukaryotic host (*Baculovirus*). In addition, serum antibody recognition of the HA head domain may not appear to be dependent on glycosylation and, at least for PR/8/34 HA, may not be negatively affected by glycosylation. HAs (hemaglutinins) from different influenza strains have variable patterns of N-linked glycosylation. (glycosylation may negatively affect immune recognition of other HAs. Serum antibody recognition of HA may be unaffected by N-glycosylation. It is possible glycosylation may otherwise influence the effectiveness, such as the half-life of a vaccine.

Example 9

Immunogenicity and Efficacy of Recombinant Flagellin-Hemagglutinin Fusion Proteins Produced in *Baculovirus*

Material and Methods

Animal studies: Female BALB/c mice (Jackson Laboratory, bar Harbor, Me.) were used at the age of 6-8 weeks. Mice were divided into groups of 10 and received inguinal subcutaneous immunizations on days 0 and 14 as follows:

1) PBS (phosphate buffered saline).
2) 3 μg of STF2.HA1-2(PR8) *E. coli* (SEQ ID NO: 90) in PBS
3) 3 μg of STF2.HA1-1(PR8) *Baculovirus* (SEQ ID NO: 151) in PBS
4) 3 μg of ngSTF2.HA1-1(PR8) *Baculovirus* (SEQ ID NO: 152) in PBS
5) 0.3 μg of ngSTF2.HA1-1(PR8) *Baculovirus* (SEQ ID NO: 152) in PBS
6) 3 μg of STF2.HA1-1(PR8) *E. coli* (SEQ ID NO: 89) in PBS
7) 0.3 μg of STF2.HA1-1(PR8) *E. coli* (SEQ ID NO: 89) in PBS Mice were bled on days 10 (primary) and 21 (boost), and sera were clarified by clotting and centrifugation and stored at −20° C. Immunized animals were challenged on day 28 with an $LD_{90}$ ($8\times10^3$ EID) of PR/8/34 virus administered intranasally (See Example 6). Mice were monitored daily for 21 days following the challenge for survival, weight loss and clinical presentation.

Serum antibody determination: HA-specific IgG levels were determined by ELISA. 96-well ELISA plates (Costar (Cat#9018), Corning, N.Y.) were coated overnight at 4° C. with 100 μl/well HA0sHis protein produced in *Drosophila* (SEQ ID NO 176) in PBS (5 μg/ml). Plates were blocked with 200 μl/well of Assay Diluent Buffer (ADB; BD Pharmingen (Cat#555213), San Diego, Calif.) for one hour at room temperature. The plates were washed three times in PBS containing 0.05% Tween-20 (PBS-T). Dilutions of the sera in ADB were added (100 μl/well) and the plates were incubated overnight at 4° C. The plates were washed three times with PBS-T. HRP-labeled goat anti-mouse IgG antibodies (Jackson Immunochemical (Cat#115-035-146)) diluted in ADB were added (100 μl/well) and the plates were incubated at room temperature for 1 hour. The plates were washed three times with PBS-T. After adding TMB Ultra substrate (Pierce (Cat#34028), Rockford, Pa.) and monitoring color development, $A_{450}$ was measured on a Tecan Farcyte (Durham, N.C.) microplate spectrophotometer.

Results and Discussion

Figure 12A:
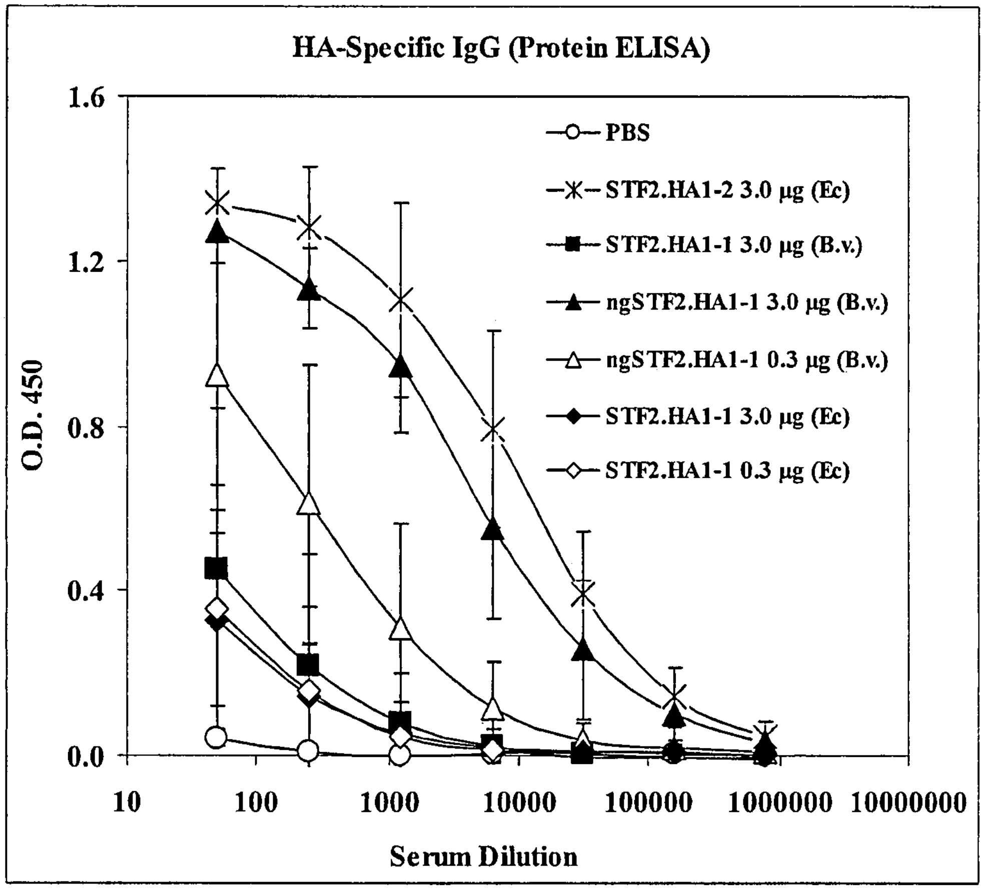
FIGS. 12A and 12B depict an anti-HA specific IgG responses in BALB/c mice immunized with STF2.HA1-1 fusion proteins. Mice (10/group) were immunized with indicated STF2.HA1-1 fusion proteins on days 0 and 14, and bled on day 21. Anti-HA and anti-flagellin IgG responses were examined by ELISA. Convalescent antisera were included as a positive control. The data depict the mean±SD of 10 individual sera per group.
Figure 12B:
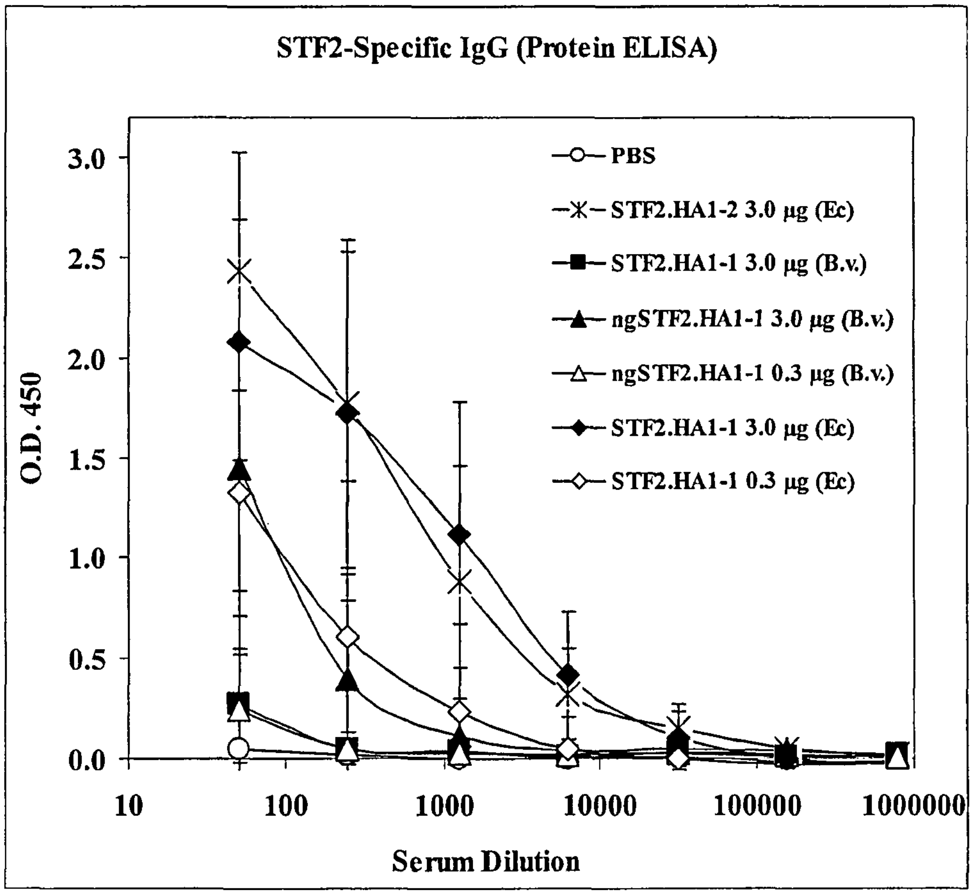

Immunogenicity and efficacy of STF2.HA1-1(PR8) expressed in *E. coli* and *Baculovirus*: BALB/c mice were immunized s.c. with 3.0 or 0.3 μg of indicated recombinant fusion proteins on days 0 and 14. On day 21 mice were bled and HA-specific IgG titers were examined by ELISA against HA0sHis (SEQ ID NO 176) expressed in *Drosophila*. FIGS. 12A,12B shows the proteins induced varying levels of HA-specific IgG with ngSTF2.HA1-1(PR8) (SEQ ID NO: 152) inducing the strongest response similar to that observed in animals immunized with STF2.HA1-2(PR8) expressed in *E. coli* (SEQ ID NO: 90). Interestingly, animals immunized with STF2.HA1-1(PR8) containing the intact glycosylation sequences expressed in *Baculovirus* (SEQ ID NO: 151) elicited little to no detectable antibody responses to HA or flagellin, in marked contrast to that observed in animals similarly immunized with STF2.HA1-1(PR8) where the consensus glycosylation sequences had been removed (SEQ ID NO: 152).

Figure 13A:
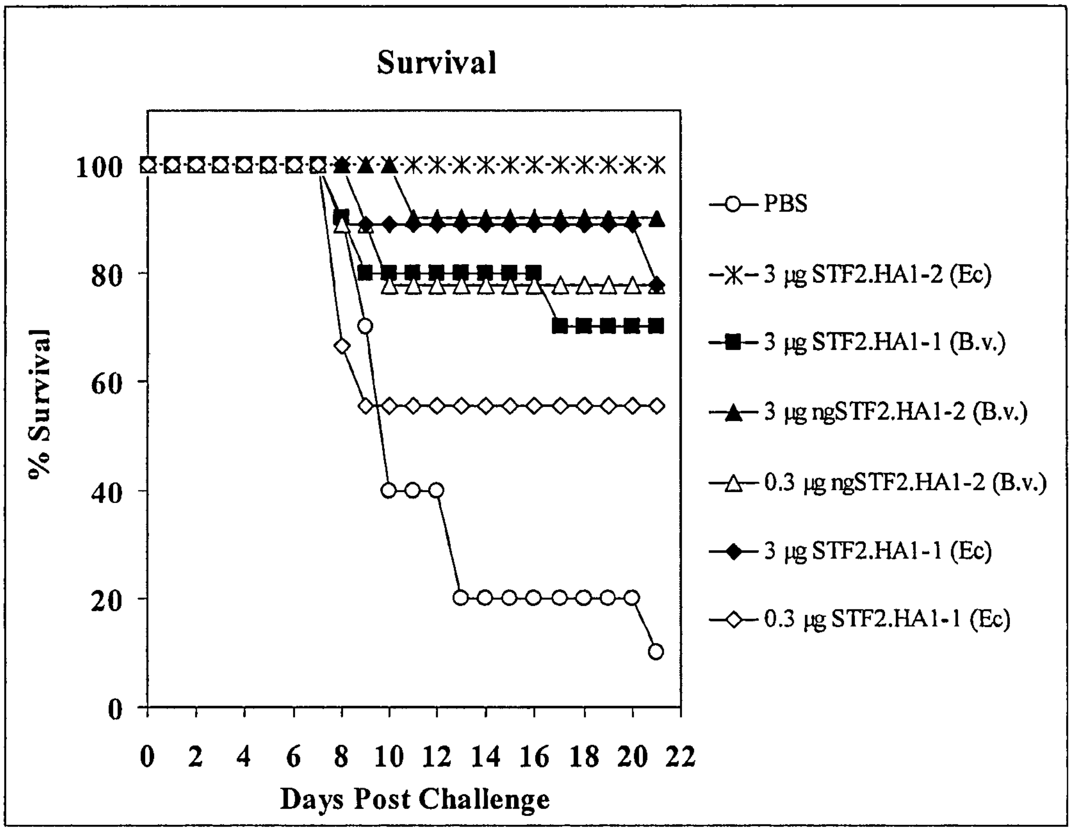
FIG. 13A depicts survival of BALB/c mice immunized with recombinant STF2.HA1-1 proteins. On day 28, animals in FIG. 12 were challenged i.n. with an $LD_{90}$ ($8\times10^3$ EID) of influenza A PR/8/34. The survival of individual mice was monitored for 21 days post challenge.
Figure 13B:
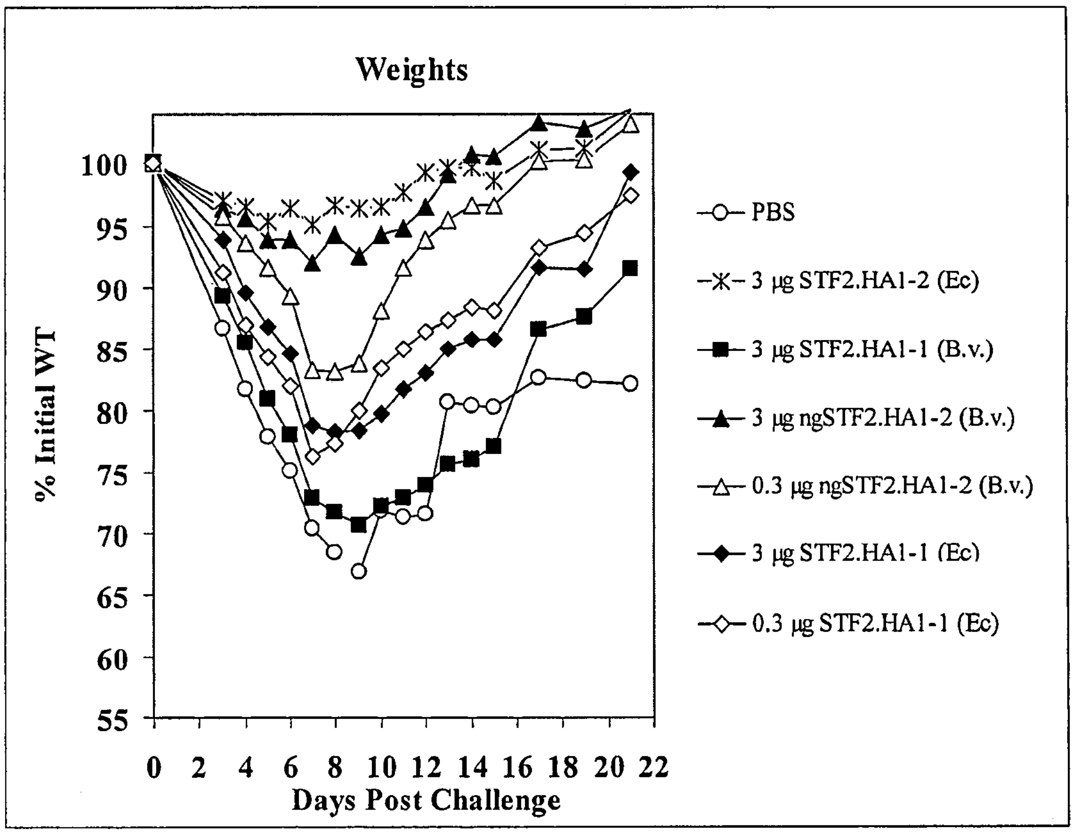
FIG. 13B depicts weight of BALB/c mice immunized with recombinant STF2.HA1-1 proteins: On day 28, animals in FIG. 12 were challenged i.n. with an $LD_{90}$ ($8\times10^3$ EID) of influenza A PR/8/34. Graph reflects the average weight per group based on individual animals measured daily for 21 days.
Figure 13C:
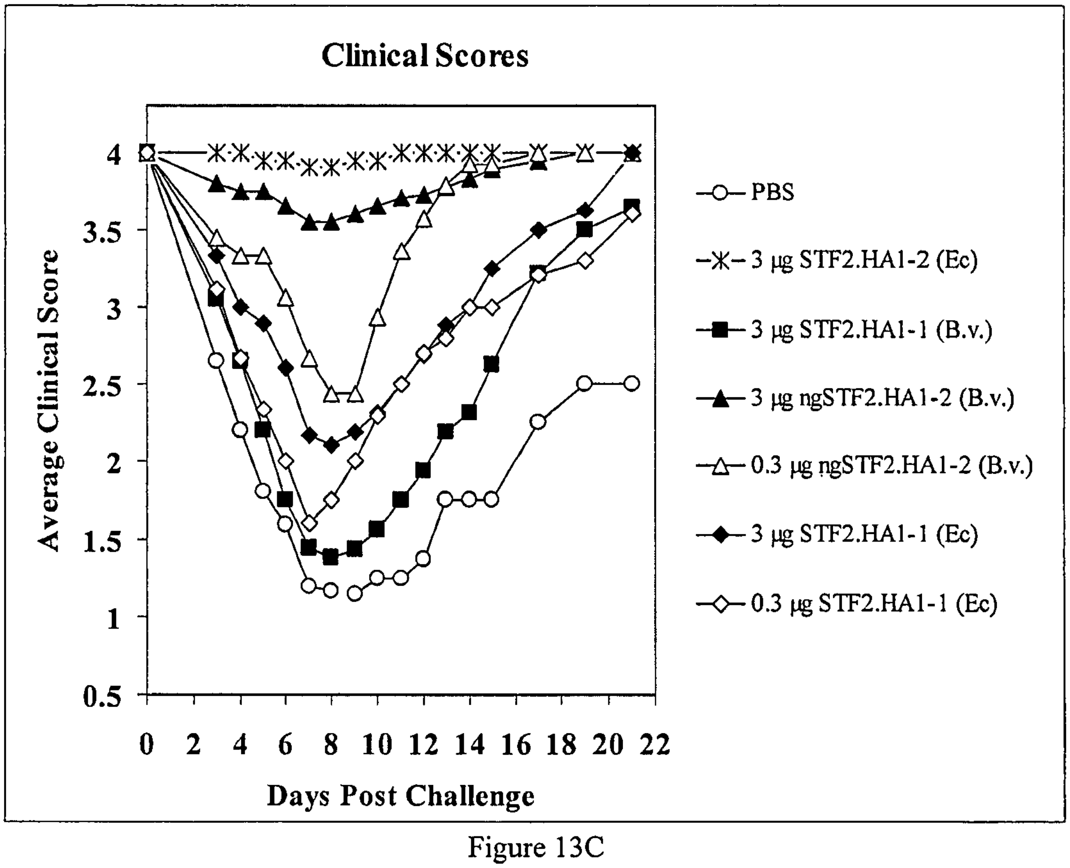
FIG. 13C depicts clinical assessment of BALB/c mice immunized with recombinant STF2.HA1-1 proteins. On day 28, animals in FIG. 12 were challenged intranasally (i.n.) with an $LD_{90}$ ($8\times10^3$ EID) of influenza A PR/8/34. Graph reflects the average weight per group based on individual animals measured daily for 21 days. Clinical scores were assessed as follows: 4 pts=healthy, 3 pts=reduced grooming, 2 pts=reduced physical activity and 1 pt=moribund.

The immunized mice were challenged on day 28 with an $LD_{90}$ ($8\times10^3$ EID) of PR/8/34 virus administered intranasally. Mice were monitored daily for 21 days following the challenge for survival, weight loss and clinical presentation. As shown in FIGS. 13A, 13B, 13C, PBS-immunized mice showed signs of infection (weight loss and lower clinical scores) as early as three days after challenge and died by day 21, while mice immunized with 3.0 μg of recombinant STF2.HA1-2(PR8) (SEQ ID NO: 90) fusion protein demonstrated enhanced protection with little to no observable clinical signs of infection or weight loss. Although animals immunized with STF2.HA1-1 fusion proteins demonstrated significantly higher efficacy than animals immunized with PBS alone, these animals demonstrated lower efficacy in terms of survival, clinical scores and overall weight loss, compared to animals receiving STF2.HA1-2(PR8) (SEQ ID NO: 90). These results demonstrate that HA subunits linked to STF2 in *Baculovirus* are immunogenic and efficacious, and suggest that STF2.HA1-1 (SEQ ID NO: 89) expressed in *E. coli* or *Baculovirus* is less immunogenic and efficacious than STF2.HA1-2 expressed in *E. coli*(SEQ ID NO: 90) or *Baculovirus*.

Example 10

Purification of STF2.HA1-2 (IND) (SEQ ID NO: 159)

Materials and Methods

Cell banking: *E. coli* cells engineered to express STF2.HA1-2(IND) (SEQ ID NO: 159) were adapted to culture in proprietary MRSF media, banked as glycerol stocks in 1 mL aliquots, and stored at −70° C.

| MRSF media, pH 7.0 | |
|---|---|
| Composition | g/L |
| Glucose | 10 |
| $KH_2PO_4$ | 7.8 |
| $(NH_4)_2SO4$ | 2.33 |
| Citric Acid | 1.0 |
| $MgSO_4(7H_20)$ | 1.0 |
| $CaCl_2$ | 0.04 |
| Trace Metals | 1 ml |
| Thiamine HCl | 0.01 |
| Kanamycin | 0.0075 |

| Trace Metal Solution 1000x | |
|---|---|
| Component | g/L |
| EDTA, disodium | 5 |
| $FeSO_4(7H_2O)$ | 10 |
| $ZnSO_4(7H_2O)$ | 2 |
| $MnSO_4(H_2O)$ | 2 |
| $CoCl_2(6H_2O)$ | 0.2 |
| $CuSO_4(5H_2O)$ | 0.1 |
| $Na_2MoO_4(2H_2O)$ | 0.2 |
| $H_3BO_3$ | 0.1 |
| $H_2O$ | 1000 ml |

Cell scale-up: Two vials (2 ml, banked in MRSF media) of *E. coli* cells engineered to express STF2.HA1-2 (IND) (SEQ ID NO: 159) were retrieved from −70° C. and inoculated into 500 ml of MRSF medium. The cells were expanded by incubation at 37° C. for 11.5 hours, at which time the $OD_{600}$ was 3.2. The cell scale up provided biomass to inoculate the production bioreactor used in the fermentation.

Fermentation: A 250 mL aliquot of scaled up cells was used to inoculate a 12 L working volume bioreactor containing 10 L of proprietary MRBR media. The culture was incubated with constant stirring while maintaining pH at 7.0±0.1, temperature at 30±0.1° C., and dissolved oxygen (DO) at no less than 30%, and was run in batch mode until the glucose was exhausted. Glucose exhaustion is indicated by a sudden decrease in $O_2$ demand, and confirmed by measurement of glucose concentration on a YSI 2700 Select glucose meter. The $OD_{600}$ for the culture at this time was 20.1 AU.

Thirty minutes after glucose exhaustion, proprietary feed media was pumped into the bioreactor at a controlled rate until 2 L of feed was added. The incubation continued for 5.5 hours under glucose-limiting conditions. At an $OD_{600}$ of 34 AU, protein expression in the culture was induced by the addition of IPTG to a final concentration of 2 mM and incubation with constant stirring for 2 hours. At the conclusion of the induction period, cells were harvested by centrifugation in an Avanti JP-20 XP centrifuge for 20 minutes at 10,000 g. The final $OD_{600}$ for the culture was 58 AU and the total protein concentration as determined by BCA was 6.73 mg/mL. 1.16 kg of cell paste was recovered from 10.8 L harvest and frozen at −20° C. The total bioreactor run time was 17 hours. STF2.HA1-2 (IND) (SEQ ID NO: 159) production was confirmed by SDS PAGE.

| MRBR Media, pH 7.0 | |
|---|---|
| Composition | g/L |
| Glucose | 20 |
| $KH_2PO_4$ | 2.2 |
| $(NH_4)_2SO_4$ | 4.5 |
| Citric Acid | 1.0 |
| $MgSO_4(7H_2O)$ | 1.0 |
| $CaCl_2$ | 0.04 |
| Trace Metals | 1 ml |
| Thiamine HCl | 0.01 |
| Antifoam | 0.05 |
| Kanamycin | 0.0075 |

| Feed media, pH 6.0 - additions to MRBR media (2 L final volume) | |
|---|---|
| Composition | g/L |
| Glucose | 160 |
| $KH_2PO_4$ | 5.6 |
| DL-Alanine | 50.0 |
| Citric Acid | 3.0 |
| $MgSO_4(7H_20)$ | 1.0 (added as 78 g/L solution) |
| $CaCl_2$ | 2.5 (added as 80 g/L solution) |
| Trace Metals | 24 ml |
| $FeSO_47H_2O$ | 0.75 |

Cell disruption and clarification: The cell paste was thawed and resuspended into a 15% suspension of 50 mM Tris, 25 mM NaCl, pH 8. The slurry was homogenized in an APV1000 homogenizer three times at 12,000 psi. The lysate was adjusted to pH 4.0 by the addition of acetic acid and centrifuged to separate soluble from insoluble material. STF2.HA1-2 (IND) (SEQ ID NO: 159) along with most other proteins partition to the insoluble fraction. The soluble material was discarded and the insoluble material (pellet) was dissolved in two times the initial lysate volume of 50 mM acetate, 1% TritonX-100, 8 M Urea, pH 4. After mixing in the homogenizer at 0 psi, the sample was centrifuged and the supernatant was collected, filtered, and stored at 4° C. The presence of STF2.HA1-2 (IND) (SEQ ID NO: 159) in the proper phases (precipitate or supernatant) was confirmed by SDS PAGE.

Cation exchange chromatography (CEX): The clarified material was applied to a 50 ml Poros 50HS column. This step was designed to reduce the endotoxin concentration, reduce the nucleic acid concentration and increase the STF2.HA1-2 (IND) (SEQ ID NO: 159) purity of the eluate as compare to the load. After loading, the column washed with five column volumes of 50 mM acetate, 1% Triton X-100, 8 M Urea, pH 4 followed by 10 column volumes of 50 mM acetate, 8 M Urea, pH 4. The protein was eluted in a 0-100% gradient to 1 M NaCl. The target protein eluted at approximately 300 mM NaCl. The major peak (eluate) was pooled and stored at 4° C. The presence of STF2.HA1-2 (IND) (SEQ ID NO: 159) in the elution was confirmed by SDS PAGE. STF2.HA1-2 (IND) (SEQ ID NO: 159) purification across this step was determined by comparing the number and intensity of protein bands in the load material to those in the elution.

Endotoxin removal in cation exchange chromatography (CEX): Endotoxin is removed from eluting STF2.HA1-2 (IND) (SEQ ID NO: 159) with the 50 mM acetate, 1% Triton X-100, 8 M Urea, pH 4 wash and with proper elution conditions. This was tested using STF2.HA1-2 (VN) (SEQ ID NO: 95) Comparing two separate cation exchange runs (Toso SP650M resin) with and without the 50 mM acetate, 1% Triton X-100, 8 M Urea, pH 4 wash (ER wash vs. no ER wash), the endotoxin concentration in the ER wash elution at 150 mM NaCl shows significantly less endotoxin concentration that the 250 mm NaCl elution from the same run, or in either of the elutions without the 50 mM acetate, 1% Triton X-100, 8 M Urea, pH 4 wash.

| Run | Elution (mM NaCl) | [Endotoxin] (EU/mL) | [Endotoxin] (EU/mg) | [protein] by BCA (g/L) | UV 280/260 |
|---|---|---|---|---|---|
| Load | N/A | $4.4 \times 10^6$ | $1.8 \times 10^6$ | 2.39 | — |
| No ER | 100 | $7.9 \times 10^6$ | $4.2 \times 10^6$ | 1.44 | 1.05 |
| wash | 250 | $8.0 \times 10^6$ | $4.1 \times 10^6$ | 1.12 | 2.76 |
| ER | 150 | 5,112 | 2,888 | 1.77 | 0.982 |
| Wash | 250 | 24,440 | N/A | N/A | 0.545 |

Refolding: The CEX eluate was dialyzed against 50 mM Tris, 8 M Urea, pH 8 buffer, and refolded by rapid dilution into 10 volumes of 50 mM Tris, pH 8.

Anion Exchange Chromatography (AEX): The refolded protein was applied to a 25 ml GE Source Q column. This step is designed to separate properly folded STF2.HA1-2 (IND) (SEQ ID NO: 159) from aggregates-and-host cell proteins and to reduce the endotoxin concentration of the eluate as compared to the load. After loading, the column washed with five column volumes of 50 mM Tris, 25 mM NaCl, pH 8. The protein was eluted in a 0-100% gradient to 1 M NaCl. A peak enriched for properly folded STF2.HA1-2(IND) (SEQ ID NO: 159) with low endotoxin (1.7 EU/mL) eluted at approximately 150 mM NaCl. A second peak eluting at approximately 170 to 270 mM NaCl contains other proteins including STF2.HA1-2 (IND) (SEQ ID NO: 159) aggregates. Fractions in first peak were pooled at stored at 4° C. Fractions from the first peak were kept for further processing. The presence of STF2.HA1-2 (IND) (SEQ ID NO: 159) in the first and second elutions was confirmed by SDS PAGE. STF2.HA1-2 (IND) (SEQ ID NO: 159) purification across this step was determined by comparing the number and intensity of protein bands in the load material to those in the elution.

Preparative size exclusion chromatography (SEC): The AEX eluate was run on a 320 ml SEC column in 2×5 mL fractions against TBS. This step is designed to separate correctly folded STF2.HA1-2 (IND) (SEQ ID NO: 159) from other proteins. Each run resulted in elution of a single major peak which was collected, pooled, and filtered through a 0.22 μm filter. The product was stored at −70° C.

The presence of STF2.HA1-2 (IND) (SEQ ID NO: 159) in the elution was confirmed by SDS PAGE. STF2.HA1-2 (IND) (SEQ ID NO: 159) purification across this step was determined by comparing the number and intensity of protein bands in the load material to those in the elution. The final material profile on SDS PAGE is a strong single band.

Results and Discussion

Final characterization of protein: Recombinant STF2.HA1-2(IND) (SEQ ID NO: 159) protein was expressed in *E. coli* and purified to homogeneity. The final product was formulated in 1×TBS (27.7 mM Tris, 2.7 mM KCl, 137 mM NaCl, pH 7.4; made from 10× stock, Teknova catalog #T9530) and stored at −70° C. in aliquots of 1.0 ml. The final yield was 15.75 ml (45 ml at a concentration of 0.35 mg/ml), with an endotoxin level of 1.1 EU/mg protein as determined by the LAL method. The protein retained TLR5 biological activity as measured in a cell-based assay of cytokine release SDS-PAGE: Protein identity was determined, and purity estimated, by SDS-PAGE. An aliquot sample was diluted in SDS-PAGE sample buffer and diluent. The samples were boiled for 5 minutes and loaded onto a 4 to 12% SDS polyacrylamide gel (Invitrogen NuPage) and electrophoresed. The gel was stained with Coomassie R-250 to visualize protein bands. Positive results for STF2.HA1-2 (IND) (SEQ ID NO: 159) were indicated by a band at about 75 kDa as compared to BioRad precision plus standards run on the same gel. Purity is estimated by visually comparing the intensity of the STF2.HA1-2 (IND) (SEQ ID NO: 159) band to all other bands.

TLR5 bioactivity assay: HEK293 cells constitutively express TLR5, and secrete several soluble factors, including IL-8, in response to TLR5 signaling. Cells were seeded in 96-well microplates (50,000 cells/well), and test proteins were added and incubated overnight. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce, #M801E and #M802B) following the manufacturer's instructions. Optical density was measured using a microplate spectrophotometer (FARCyte, Amersham).

Endotoxin assay: Endotoxin levels were determined using the QCL-1000 Quantitative Chromogenic LAL test kit (Cambrex), following the manufacturer's instructions for the microplate method.

Protein assay: Total protein concentration was determined using the Micro BCA (bicinchoninic acid) Assay (Pierce) in the microplate format, using bovine serum albumin as a standard, according to the manufacturer's instructions.

UV280/260 assay: This assay is a measure of the nucleic acid concentration in a sample as compared to the protein concentration. The absorbance maximum occurs at approximately 260 nm for nucleic acids, while the absorbance maximum occurs for proteins at approximately 280 nm. A higher ratio between the absorbance at 280 nm versus the absorbance at 260 nm indicates a sample enriched in protein over nucleic acids.

Example 11

Cloning, Expression, and Biochemical Characterization of Recombinant Flagellin-Hemagglutinin Fusion Proteins Produced in *Drosophila*

Materials and Methods

Cloning and expression of HA in *Drosophila*: RNA was isolated from the influenza A strain A/Puerto Rico/8/34 using QIAamp MinElute Virus Spin Kit (Qiagen, Cat#57704) following the manufacturer's instructions. The HA RNA was reverse transcribed using SuperScript III First Strand Synthesis System for RT-PCR (Invitrogen; Cat #18080-051) or SuperScript III One-Step RT-PCR System with Platinum-Taq High Fidelity (Invitrogen; Cat#12574-030) following the manufacturer's instructions, and the cDNA was cloned using the TOPO cloning vector PCRII Zero Blunt (Invitrogen). The HA0s fragment (HA gene without the signal sequence and trans-membrane domain) was then sub-cloned into pMT/STF2Δ at both the C-terminus and $NH_2$ terminus of the cassette using PCR-based strategy to generate the constructs STF2Δ.HA0s (PR8) (SEQ ID NO: 160) and HA0s(PR8) .STF2Δ (SEQ ID NO: 167) respectively. The HA gene was also cloned into the pMT/Bip/V5-his vector without STF2Δ to generate the construct HA0s.his (SEQ ID NO: 170). Table 10 list the constructs and the primers used in their construction.

TABLE 10

PR8 HA constructs for expression in *Drosophila*

| SEQ ID NO: | Construct | FOR Primer SEQ ID NO: | REV Primer SEQ ID NO: | DNA Template SEQ ID NO: |
|---|---|---|---|---|
| 160 | STF2Δ.HA0sHis | 161 | 162 | 163 |
| 164 | STF2Δ.HA0s | 165 | 166 | 163 |
| 167 | HA0s.STF2Δ | 168 | 169 | 163 |
| 170 | HA0sHis | 171 | 172 | 163 |
| 173 | HA0s | 174 | 175 | 163 |

Recombinant protein expression from *Drosophila* Dmel-2 cells: The HA0s.His (SEQ ID NO: 170) and STF2Δ.HA0s (SEQ ID NO: 164) plasmids were co-transfected with the pCoBlast plasmid into *Drosophila* Dmel-2 cells to generate Dmel-2 HA0sHis(PR8) and Dmel-2 STF2Δ.HA0s(PR8) stable cells. Dmel-2 stable cells were expanded from adherent to shaker cultures in selection media [*Drosophila* Sfm medium (Invitrogen; Carlsbad, Calif.)+25 μg/ml blasticidin] and then expanded to a 12 L production scale.

Recombinant protein expression was induced by the addition of $CuSO_4$ to a final concentration of 0.5 mM. After incubation for 72 hours cells were removed from the conditioned medium by centrifugation. The conditioned medium was then clarified by passing through a 0.22 μm filter and stored at 4° C.

Purification of HA0sHis(PR8) (SEQ ID NO: 176): Conditioned medium was applied to a Chelating Sepharose column (GE/Amersham Biosciences; Piscataway, N.J.) charged with $NiSO_4$ and equilibrated in Buffer A [20 mM Tris, pH 8.0, 0.5 M NaCl] and eluted in a linear gradient with Buffer B [Buffer A+0.5 M imidazole]. The protein was further purified by fractionation on a Superdex 200 SEC column (GE/Amersham Biosciences; Piscataway, N.J.) equilibrated in 1× Tris-buffered saline (TBS), pH 8.0. HA0s.$His_6$(PR8) fractions were pooled, aliquoted and stored at −80° C.

SDS-PAGE and western blot analysis: Protein identity was determined, and purity estimated, by SDS-PAGE. An aliquot of 5 μg of each sample was diluted in SDS-PAGE sample buffer with or without 100 mM DTT as a reductant. The samples were boiled for 5 minutes and loaded onto a 10% SDS polyacrylamide gel (LifeGels; French's Forrest, New South Wales, AUS) and electrophoresed. The gel was stained with Coomassie R-250 (Bio-Rad; Hercules, Calif.) to visualize protein bands. For western blot, 0.5 μg/lane total protein was electrophoresed as described above and the gels were then electro-transferred to a PVDF membrane and blocked with 5% (w/v) dry milk before probing with anti-flagellin antibody (Inotek; Beverly, Mass.), anti-$His_6$.antibody (Invitrogen; Carlsbad, Calif.) or influenza A PR/8/34 convalescent immune serum (described below under Protein Antigenicity ELISA). After probing with alkaline phosphatase-conjugated secondary antibodies (Pierce; Rockford, Ill.), protein bands were visualized with an alkaline phosphatase chromogenic substrate (Promega; Madison, Wis.).

Protein assay: Total protein concentration was determined using the Micro BCA (bicinchoninic acid) Assay (Pierce; Rockford, Ill.) in the microplate format, using bovine serum albumin as a standard, according to the manufacturer's instructions.

Endotoxin assay: Endotoxin levels were determined using the QCL-1000 Quantitative Chromogenic LAL test kit (Cambrex; E. Rutherford, N.J.), following the manufacturer's instructions for the microplate method.

TLR5 bioactivity assay: HEK293 cells constitutively express TLR5, and secrete several soluble factors, including IL-8, in response to TLR5 signaling. Cells were seeded in 96-well microplates (50,000 cells/well), and recombinant *drosophila* conditioned medium containing either HA0sHis (PR8) (SEQ ID NO: 176) or STF2Δ.HA0s(PR8) (SEQ ID NO: 177) was added. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockford, Ill., #M801E and #M802B) following the manufacturer's instructions. Optical density was measured using a microplate spectrophotometer (FARCyte, GE/Amersham; Piscataway, N.J.).

Protein antigenicity ELISA: Purified HA0s.$His_6$(PR8) (SEQ ID NO: 176) was tested by ELISA to determine if the recombinant protein displayed correctly folded epitopes of HA. 96-well ELISA plates were coated overnight at 4° C. with serial dilutions in PBS (100 μl/well) of HA0s.$His_6$(PR8) (SEQ ID NO: 176) protein starting at 5 μg/ml. Plates were blocked with 200 μl/well of Assay Diluent Buffer (ADB; BD Pharmingen) for one hour at room temperature, then washed three times in PBS-T. A fixed dose of primary antibody was then added to each well. To assay HA reactivity, 100 μl/well of a 1:10,000 dilution of non-immune or PR/8/34 convalescent immune serum in ADB was added. PR/8/34 immune serum was generated in BALB/c mice (Jackson Laboratory, Bar Harbor, Me.) that received an experimentally determined sublethal challenge dose of $8\times10^1$ egg infectious dosages (EID) of PR/8/34 influenza virus.

Animals were then allowed to convalesce for >21 days post-infection at which time immune serum was isolated and clarified. For ELISA of the 6× histidine tag, monoclonal antibody against 6× His (Invitrogen; Carlsbad, Calif.), or flagellin (Inotek; Beverly, Mass.) was added at 1 μg/ml in ADB (100 μl/well) and the plates were incubated for 1 hr at room temperature or overnight at 4° C. The plates were then washed three times with PBS-T. HRP-labeled goat anti-mouse IgG antibodies (Jackson Immunochemical; West Grove, Pa.) diluted in ADB were added (100 μl/well) and the plates were incubated at room temperature for 1 hour. The plates were washed three times with PBS-T. After adding TMB Ultra substrate (Pierce; Rockford, Ill.) and monitoring color development, $A_{450}$ was measured on a microplate spectrophotometer (FARCyte, GE/Amersham; Piscataway, N.J.).

Results and Discussion

Characterization of *Drosphila*-expressed HA0s proteins: Western blot analysis of conditioned media with anti-$His_6$ antibody (Invitrogen; Carlsbad, Calif.) confirmed expression of HA0sHis(PR8) (SEQ ID NO: 176) and western blot with anti-flagellin antibody (Inotek; Beverly, Mass.) confirmed expression of STF2Δ.HA0s(PR8) (SEQ ID NO: 177) by *Drosophila* Dmel-2 cells transfected with the corresponding expression plasmid. Both proteins were recognized by western blot in non-reduced form with mouse PR/8/34 convalescent immune serum while reduction of the proteins with DTT abrogated recognition. This result indicates correct disulfide bonding of the two secreted proteins. The STF2Δ.HA0s(PR8) (SEQ ID NO: 177) conditioned medium showed significant in vitro TLR5 activity while the $HA0sHis_6$(PR8) (SEQ ID NO: 176) medium did not, as expected. Finally, purified $HA0sHis_6$(PR8) (SEQ ID NO: 176) protein showed significant reactivity with influenza A PR8/34 convalescent immune serum by ELISA. These results indicate that both HA0s proteins are secreted from *Drosophila* Dmel-2 cells in a properly folded form.

Example 12

Immunogenicity and Efficacy of Recombinant Flagellin-Hemagglutinin Fusion Proteins Representing Viral Strain A/Viet Nam/1203/04

Materials and Methods

Animal studies: Female BALB/c mice were used at the age of 6-8 weeks. Mice were divided into groups of 15 and received subcutaneous (s.c) immunizations on days 0 and 14 as follows:

TBS (phosphate buffered saline)
No immunization
10 μg of STF2.HA1-2(VN) (SEQ ID NO: 95) in TBS
3.0 μg of STF2.HA1-2(VN) (SEQ ID NO: 95) in PBS
1 μg of STF2.HA1-2(VN) (SEQ ID NO: 95) in TBS Mice were bled on day 21 and sera were clarified by clotting and centrifugation and stored at −20° C.

Serum antibody determination: HA-specific IgG levels were determined by ELISA. 96-well ELISA plates (Costar (Cat #9018) Corning, N.Y.) were coated overnight at 4° C. with 100 μl/well recombinant HA protein from A/Vietnam/1203/04, produced in *Baculovirus*, (BEIR catalog number NR-660) in PBS (1 μg/ml). Plates were blocked with 300 μl/well of Assay Diluent Buffer (ADB; BD Pharmingen, (Cat#: 555213)(San Diego, Calif.) for two hours at 25° C. The plates were washed three times in PBS+0.05% (v/v) Tween 20 (PBS-T). Dilutions of the sera in ADB were added (100 μl/well) and the plates were incubated for 1.5 hours at 25° C. The plates were washed three times with PBS-T. HRP-labeled goat anti-mouse IgG antibodies (Jackson Immunochemical, West Grove, Pa. (Cat#: 115-035-146)) diluted in ADB were added (100 μl/well) and the plates were incubated at 25° C. for 30 minutes. The plates were washed three times with PBS-T. After adding TMB Ultra substrate (Pierce (Cat 34028), Rockford, Ill.)) and monitoring color development, $A_{450}$ was measured on a SpectraMax 190 (Molecular Devices, Sunnyvale, Calif.) microplate spectrophotometer.

Influenza virus challenge of mice: To assess efficacy, mice were challenged on day 28 by intranasal administration of 10 $LD_{90}$ (10× dose lethal to 90% of mice) ($6\times10^3$ EID) of influenza A/Viet Nam/1203/04. Animals were monitored daily for 21 days following the challenge for survival and clinical presentation.

Preparation of Influenza H5N1 Stocks: Influenza A/Vietnam/1203/04 (H5N1) was obtained from the Centers for Disease Control and Prevention (Atlanta, Ga.). Stocks of the virus were prepared in 10-day-old embryonated chicken eggs, and aliquots of 0.5 ml were stored at −80° C. until use.

Determination of Viral Titers: $TCID_{50}$ (50% tissue culture infectious dose) was determined utilizing MDCK cells seeded into the wells of 96-well plate and grown to confluency. A series of $\log_{10}$ dilutions of the virus was inoculated onto the plate in quadruplicates. The plate was then incubated for 48-72 hours. The $TCID_{50}$ was determined by identifying the dilution at which quadruplicate wells were ½ positive and ½ negative for viral growth. The $EID_{50}$ was determined by inoculating $\log_{10}$ dilutions of the stock into 2-4 eggs per dilution. Eggs were incubated for 40-48 hours, and 1 ml of the allantoic fluid was harvested from each egg. $EID_{50}$ was calculated as the dilution at which ½ of the eggs were negative and ½ of the eggs were positive for infectious virus.

Results and Discussion

Figure 14:
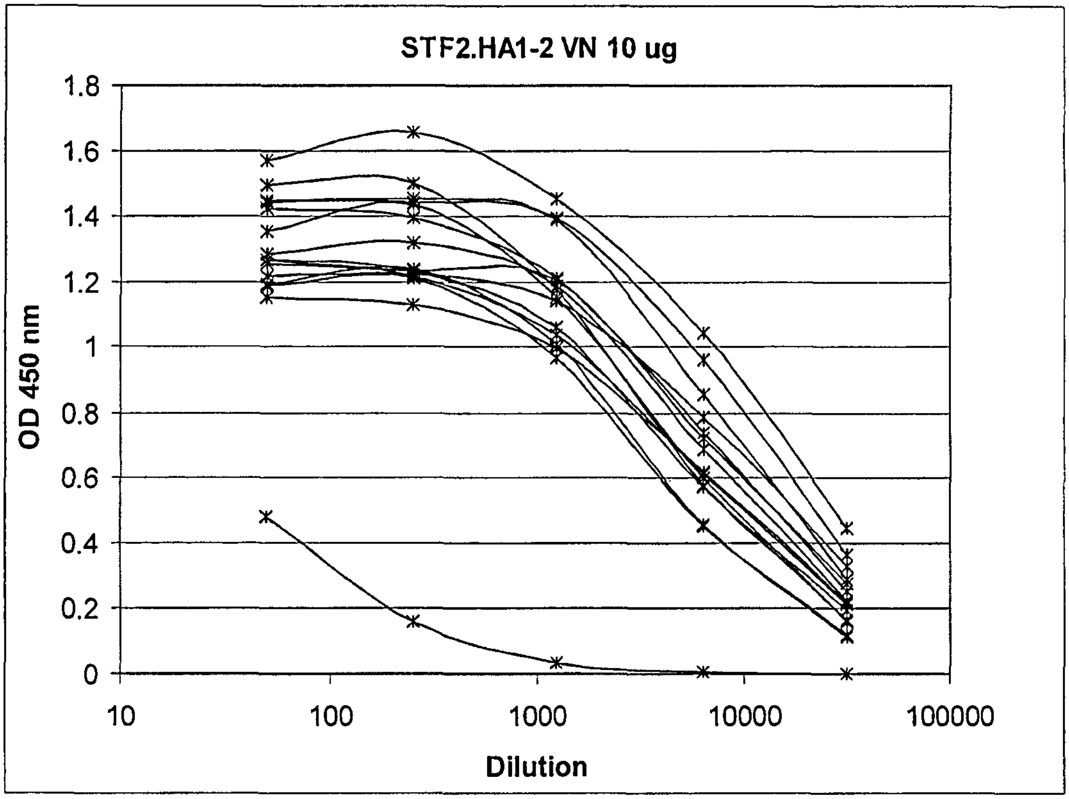
FIG. 14 depicts anti-HA antibody titers of mice following immunization with 10 μg STF2.HA1-2(VN).
Figure 15:
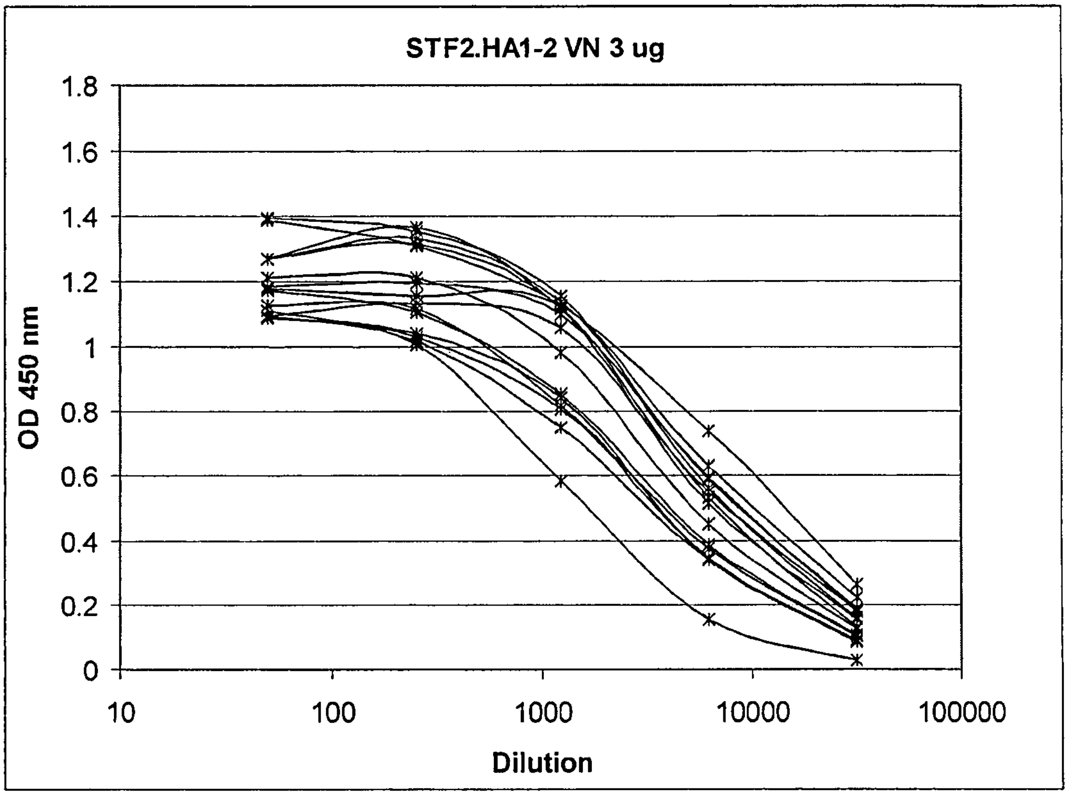
FIG. 15 depicts an anti-HA antibody titers of mice following immunization with 3 μg STF2.HA1-2(VN).
Figure 16:
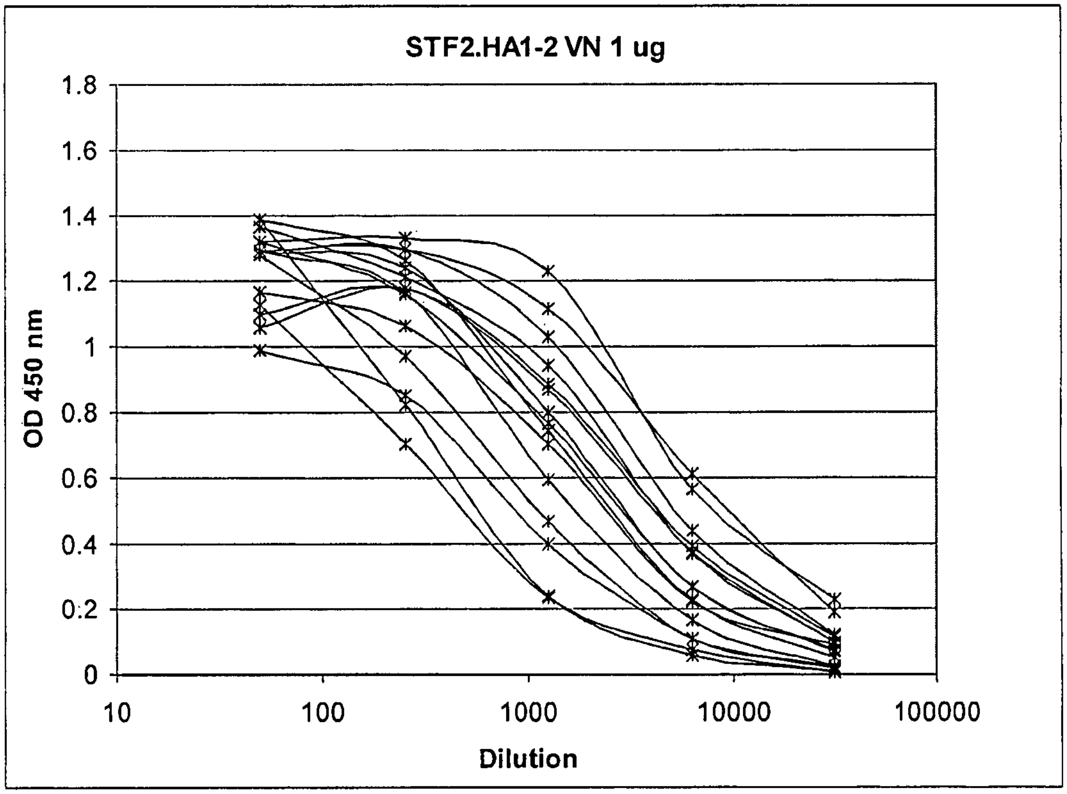
FIG. 16 depicts an anti-HA antibody titers of mice following immunization with 1 μg STF2.HA1-2(VN).

Induction of HA-specific IgG response following immunization with STF2.HA1-2(VN) (SEQ ID NO: 95): The immunogenicity of STF2.HA1-2(VN) (SEQ ID NO: 95) was examined by immunizing BALB/c mice (15/group) subcutaneously on day 0 and 14 with a dose range of 10, 3, and 1 μg protein. Negative control groups of mice were immunized with TBS or not immunized. HA-specific IgG responses were examined 7 days post boost (Day 21) by ELISA. The results demonstrate that immunization with 10, 3 or 1 μg of STF2.HA1-2(VN) (SEQ ID NO: 95) induced consistent and significant HA-specific IgG responses in a dose-dependent manner (FIGS. 14-16).

Figure 17:
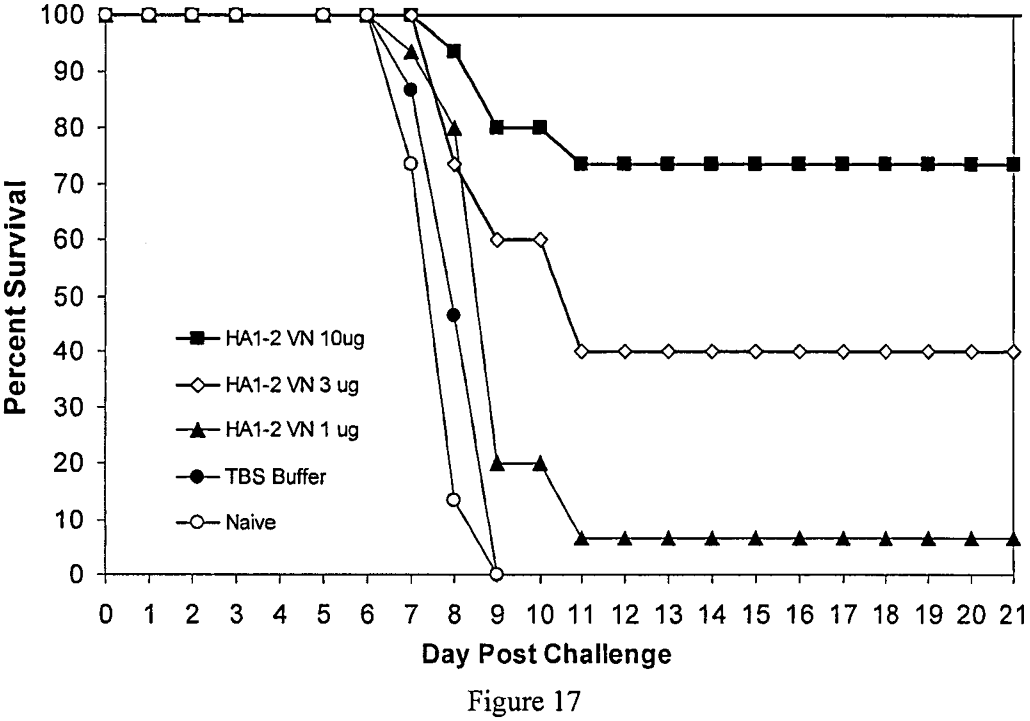
FIG. 17 depicts a survival of mice following challenge with 10 $LD_{90}$ of influenza A/Viet Nam/1203/04

Immunization with STF2.HA1-2(VN) (SEQ ID NO: 95) provides protection from a lethal challenge with influenza A: The serological analysis described above demonstrated that immunization of mice with STF2.HA1-2(VN) (SEQ ID NO: 95) generated an antibody response that recognized native HA. In order to evaluate efficacy, the same mice were challenged on day 28 with 10 $LD_{90}$ ($6\times10^3$ EID) of A/Viet Nam/1203/04 virus administered intra-nasally. Mice were monitored daily for 21 days following the challenge for survival and clinical presentation. As shown in FIG. 17, TBS-immunized or naïve mice showed signs of infection (weight loss and lower clinical scores) as early as five days post-challenge and all mice died by day nine post-challenge. For the mice immunized with STF2.HA1-2(VN), there is a clear relationship between the dose received and efficacy. Mice immunized with 10 μg of STF2.HA1-2(VN) (SEQ ID NO: 95) demonstrated markedly enhanced protection. Mice immunized with 3 or 1 μg of STF2.HA1-2(VN) (SEQ ID NO: 95) demonstrated a modest to a negligible impact on efficacy, respectively. Clinical parameters were similarly related to dose and animals receiving the highest dose of STF2.HA1-2(VN) (SEQ ID NO; 95) exhibited the mildest signs of disease. These results demonstrate that *E. coli*-expressed STF2.HA1-2(VN) (SEQ ID NO: 95) induces HA-specific immune responses that successfully protect BALB/c mice from a lethal challenge with virulent influenza A virus in vivo.

```
SEQ ID NO: 1 A/Puerto Rico/8/34 HA
MKANLLVLLSALAAADADTICIGYHANNSTDTVDTVLEKNVTVTHSVNLL

EDSHNGKLCRLKGIAPLQLGKCNIAGWLLGNPECDPLLPVRSWSYIVETP

NSENGICYPGDFIDYEELREQLSSVSSFERFEIFPKESSWPNHNTNGVTA

ACSHEGKSSFYRNLLWLTEKEGSYPKLKNSYVNKKGKEVLVLWGIHHPPN

SKEQQNLYQNENAYVSVVTSNYNRRFTPEIAERPKVRDQAGRMNYYWTLL

KPGDTIIFEANGNLIAPMYAFALSRGFGSGIITSNASMHECNTKCQTPLG

AINSSLPYQNIHPVTIGECPKYVRSAKLRMVTGLRNIPSIQSRGLFGAIA

GFIEGGWTGMIDGWYGYHHQNEQGSGYAADQKSTQNAINGITNKVNTVIE

KMNIQFTAVGKEFNKLEKRMENLNKKVDDGFLDIWTYNAELLVLLENERT

LDFHDSNVKNLYEKVKSQLKNNAKEIGNGCFEFYHKCDNECMESVRNGTY
```

-continued

DYPKYSEESKLNREKVDGVKLESMGIYQILAIYSTVASSLVLLVSLGAI

SFWMCSNGSLQCRICI

SEQ ID NO: 2 A/Viet Nam/1203/2004 HA
MEKIVLLFAIVSLVKSDQICIGYHANNSTEQVDTIMEKNVTVTHAQDILE

KKHNGKLCDLDGVKPLILRDCSVAGWLLGNPMCDEFINVPEWSYIVEKAN

PVNDLCYPGDFNDYEELKHLLSRINHFEKIQIIPKSSWSSHEASLGVSSA

CPYQGKSSFFRNVVWLIKKNSTYPTIKRSYNNTNQEDLLVLWGIHHPNDA

AEQTKLYQNPTTYISVGTSTLNQRLVPRIATRSKVNGQSGRMEFFWTILK

PNDAINFESNGNFIAPEYAYKIVKKGDSTIMKSELEYGNCNTKCQTPMGA

INSSMPFHNIHPLTIGECPKYVKSNRLVLATGLRNSPQRERRRKKRGLFG

AIAGFIEGGWQGMVDGWYGYHHSNEQGSGYAADKESTQKAIDGVTNKVNS

IIDKMNTQFEAVGREFNNLERRIENLNKKMEDGFLDVWTYNAELLVLMEN

ERTLDFHDSNVKNLYDKVRLQLRDNAKELGNGCFEFYHKCDNECMESVRN

GTDYPQYSEEARLKREEISGVKLESIGIYQILSIYSTVASSLALAIMVAG

LSLWMCSNGSLQCR

SEQ ID NO: 3 A/Indonesia/5/2005 HA
MEKIVLLLAIVSLVKSDQICIGYHANNSTEQVDTIMEKNVTVTHAQDILE

KTHNGKLCDLDGVKPLILRDCSVAGWLLGNPMCDEFINVPEWSYIVEKAN

PTNDLCYPGSFNDYEELKHLLSRINHFEKIQIIPKSSWSDHEASSGVSSA

CPYLGSPSFFRNVVWLIKKNSTYPTIKKSYNNTNQEDLLVLWGIHHPNDA

AEQTRLYQNPTTYISIGTSTLNQRLVPKIATRSKVNGQSGRMEFFWTILK

PNDAINFESNGNFIAPEYAYKIVKKGDSAIMKSELEYGNCNTKCQTPMGA

INSSMPFHNIHPLTIGECPKYVKSNRLVLATGLRNSPQRESRRKKRGLFG

AIAGFIEGGWQGMVDGWYGYHHSNEQGSGYAADKESTQKAIDGVTNKVNS

IIDKMNTQFEAVGREFNNLERRIENLNKKMEDGFLDVWTYNAELLVLMEN

ERTLDFHDSNVKNLYDKVRLQLRDNAKELGNGCFEFYHKCDNECMESIRN

GTYNYPQYSEEARLKREEISGVKLESIGTYQILSIYSTVASSLALAIMMA

GLSLWMCSNGSLQCRICI

SEQ ID NO: 4 A/NewCaledonia/20/1999
MKAKLLVLLCTFTATYADTICIGYHANNSTDTVDTVLEKNVTVTHSVNLL

EDSHNGKLCLLKGIAPLQLGNCSVAGWILGNPECELLISKESWSYIVETP

NPENGTCYPGYFADYEELREQLSSVSSFERFEIFPKESSWPNHTVTGVSA

SCSHNGKSSFYRNLLWLTGKNGLYPNLSKSYVNNKEKEVLVLWGVHHPPN

IGNQRALYHTENAYVSVVSSHYSRRFTPEIAKRPKVRDQEGRINYYWTLL

EPGDTIIFEANGNLIAPWYAFALSRGFGSGIITSNAPMDECDAKCQTPQG

AINSSLPFQNVHPVTIGECPKYVRSAKLRMVTGLRNIPSIQSRGLFGAIA

GFIEGGWTGMVDGWYGYHHQNEQGSGYAADQKSTQNAINGITNKVNSVIE

KMNTQFTAVGKEFNKLERRMENLNKKVDDGFLDIWTYNAELLVLLENERT

LDFHDSNVKNLYEKVKSQLKNNAKEIGNGCFEFYHKCNNECMESVKNGTY

DYPKYSEESKLNREKIDGVKLESMGVYQILAIYSTVASSLVLLVSLGAIS

FWMCSNGSLQCRICI

-continued

SEQ ID NO: 5 A/South Carolina/1/18HA
MEARLLVLLCAFAATNADTICIGYHANNSTDTVDTVLEKNVTVTHSVNLL

EDSHNGKLCKLKGIAPLQLGKCNIAGWLLGNPECDLLLTASSWSYIVETS

NSENGTCYPGDFIDYEELREQLSSVSSFEKFEIFPKTSSWPNHETTKGVT

AACSYAGASSFYRNLLWLTKKGSSYPKLSKSYVNNKGKEVLVLWGVHHPP

TGTDQQSLYQNADAYVSVGSSKYNRRFTPEIAARPKVRDQAGRMNYYWTL

LEPGDTITFEATGNLIAPWYAFALNRGSGSGIITSDAPVHDCNTKCQTPH

GAINSSLPFQNIHPVTIGECPKYVRSTKLRMATGLRNIPSIQSRGLFGAI

AGFIEGGWTGMIDGWYGYHHQNEQGSGYAADQKSTQNAIDGITNKVNSVI

EKMNTQFTAVGKEFNNLERRIENLNKKVDDGFLDIWTYNAELLVLLENER

TLDFHDSNVRNLYEKVKSQLKNNAKEIGNGCFEFYHKCDDACMESVRNGT

YDYPKYSEESKLNREEIDGVKLESMGVYQILAIYSTVASSLVLLVSLGAI

SFWMCSNGSLQCRICI

SEQ ID NO: 6 A/Wisconsin/67/2005 HA
QKLPGNDNSTATLCLGHHAVPNGTIVKTITNDQIEVTNATELVQSSSTGG

ICDSPHQILDGENCTLIDALLGDPQCDGFQNKKWDLFVERSKAYSNCYPY

DVPDYASLRSLVASSGTLEFNDESFNWTGVTQNGTSSACKRRSNNSFFSR

LNWLTHLKFKYPALNVTMPNNEKFDKLYIWGVHHPGTDNDQIFLHAQASG

RITVSTKRSQQTVIPNIGSRPRIRNIPSRISIYWTIVKPGDILLINSTGN

LIAPRGYFKIRSGKSSIMRSDAPIGKCNSECITPNGSIPNDKPFQNVNRI

TYGACPRYVKQNTLKLATGMRNVPEKQTR

SEQ ID NO: 7 A/X31 subtype H3N2 HA
QDLPGNDNSTATLCLGHHAVPNGTLVKTITDDQIEVTNATELVQSSSTGK

ICNNPHRILDGIDCTLIDALLGDPHCDVFQNETWDLFVERSKAFSNCYPY

DVPDYASLRSLVASSGTLEFITEGFTWTGVIQNGGSNACKRGPGSGFFSR

LNWLTKSGSTYPVLNVTMPNNDNFDKLYIWGIHHPSTNQEQTSLYVQASG

RVTVSTRRSQQTIIPNIGSRPWVRGLSSRISIYWTIVKPGDVLVINSNGN

LIAPRGYFKMRTGKSSIMRSDAPIDTCISECITPNGSIPNDKPFQNVNKI

TYGACPKYVKQNTLKLATGMRNVPEKQT

SEQ ID NO: 8 PR/8 HA1-1
SHNGKLCRLKGIAPLQLGKCNIAGWLLGNPECDPLLPVRSWSYIVETPNS

ENGICYPGDFIDYEELREQLSSVSSFERFEIFPKESSWPNHNTNGVTAAC

SHEGKSSFYRNLLWLTEKEGSYPKLKNSYVNKKGKEVLVLWGIHHPPNSK

EQQNLYQNENAYVSVVTSNYNRRFTPEIAERPKVRDQAGRMNYYWTLLKP

GDTIIFEANGNLIAPMYAFALSRGFGSGIITSNASMHECNTKCQTPLGAI

NSSLPYQNIHPVTIGECPKYVR

SEQ ID NO: 9 PR/8 HA1-2
KGIAPLQLGKCNTAGWLLGNPECDPLLPVRSWSYIVETPNSENGICYPGD

FIDYEELREQLSSVSSFERFEIFPKESSWPNHNTNGVTAACSHEGKSSFY

RNLLWLTEKEGSYPKLKNSYVNKKGKEVLVLWGIHHPPNSKEQQNLYQNE

NAYVSVVTSNYNRRFTPEIAERPKVRDQAGRMNYYWTLLKPGDTIIFEAN

GNLIAPMYAFALSRGFGSGIITS

-continued

SEQ ID NO: 10 PR/8 HA1-3
NSENGICYPGDFIDYEELREQLSSVSSFERFEIPPKESSWPNHNTNGVTA

ACSHEGKSSFYRNLLWLTEKEGSYPKLKNSYVNKKGKEVLVLWGIHHPPN

SKEQQNLYQNENAYVSVVTSNYNRRFTPEIAERPKVRDQAGRMNYYWTLL

KPGDTIIFEANGNLIAPMYAFALSRG

SEQ ID NO: 11 VN HA1-1
EKKHNGKLCDLDGVKPLILRDCSVAGWLLGNPMCDEFINVPEWSYIVEKA

NPVNDLCYPGDFNDYEELKHLLSRINHFEKIQIIPKSSWSSHEASLGVSS

ACPYQGKSSFFRNVVWLIKKNSTYPTIKRSYNNTNQEDLLVLWGIHHPND

AAEQTKLYQNPTTYISVGTSTLNQRLVPRIATRSKVNGQSGRMEFFWTIL

KPNDAINFESNGNFIAPEYAYKIVKKGDSTIMKSELEYGNCNTKCQTPMG

AINSSMPFHNIHPLTIGECPKYVK

SEQ ID NO: 12 VN HA1-2
GVKPLILRDCSVAGWLLGNPMCDEFINVPEWSYIVEKANPVNDLCYPGDF

NDYEELKHLLSRINHFEKIQIIPKSSWSSHEASLGVSSACPYQGKSSFFR

NVVWLIKKNSTYPTIKRSYNNTNQEDLLVLWGIHHPNDAAEQTKLYQNPT

TYISVGTSTLNQRLVPRIATRSKVNGQSGRMEFFWTILKPNDAINFESNG

NFIAPEYAYKIVKKGDSTIMKSE

SEQ ID NO: 13 VN HA1-3
NDLCYPGDFNDYEELKHLLSRINHFEKIQIIPKSSWSSHEASLGVSSACP

YQGKSSFFRNVVWLIKKNSTYPTIKRSYNNTNQEDLLVLWGIHHPNDAAE

QTKLYQNPTTYISVGTSTLNQRLVPRIATRSKVNGQSGRMEFFWTILKPN

DAINFESNGNFIAPEYAYKIVKKG

SEQ ID NO: 14 IND HA1-1
EKTHNGKLCDLDGVKPLILRDCSVAGWLLGNPMCDEFINVPEWSYIVEKA

NPTNDLCYPGSFNDYEELKHLLSRINHFEKIQIIPKSSWSDHEASSGVSS

ACPYLGSPSFFRNVVWLIKKNSTYPTIKKSYNNTNQEDLLVLWGIHHPND

AAEQTRLYQNPTTYISIGTSTLNQRLVPKIATRSKVNGQSGRMEFFWTIL

KPNDAINFESNGNFIAPEYAYKIVKKGDSAIMKSELEYGNCNTKCQTPMG

AINSSMPFHNIHPLTIGECPKYVK

SEQ ID NO: 15 IND HA1-2
GVKPLILRDCSVAGWLLGNPMCDEFINVPEWSYIVEKANPTNDLCYPGSF

NDYEELKHLLSRINHFEKIQIIPKSSWSDHEASSGVSSACPYLGSPSFFR

NVVWLIKKNSTYPTIKKSYNNTNQEDLLVLWGIHHPNDAAEQTRLYQNPT

TYISIGTSTLNQRLVPKIATRSKVNGQSGRMEFFWTILKPNDAINFESNG

NFIAPEYAYKIVKKGDSAIMKSE

SEQ ID NO: 16 IND HA1-3
NDLCYPGSFNDYEELKHLLSRINHFEKIQIIPKSSWSDHEASSGVSSACP

YLGSPSFFRNVVWLIKKNSTYPTIKKSYNNTNQEDLLVLWGIHHPNDAAE

QTRLYQNPTTYISIGTSTLNQRLVPKIATRSKVNGQSGRMEFFWTILKPN

DAINFESNGNFIAPEYAYKIVKKG

SEQ ID NO: 17 NC HA1-1
SHNGKLCLLKGIAPLQLGNCSVAGWILGNPECELLISKESWSYIVETPNP

ENGTCYPGYFADYEELREQLSSVSSFERFEIFPKESSWPNHTVTGVSASC

SHNGKSSFYRNLLWLTGKNGLYPNLSKSYVNNKEKEVLVLWGVHHPPNIG

NQRALYHTENAYVSVVSSHYSRRFTPEIAKRPKVRDQEGRINYYWTLLEP

GDTIIFEANGNLIAPWYAFALSRGFGSGIITSNAPMDECDAKCQTPQGAI

NSSLPFQNVHPVTTGECPKYVR

SEQ ID NO: 18 NC HA1-2
KGIAPLQLGNCSVAGWILGNPECELLISKESWSYIVETPNPENGTCYPGY

FADYEELREQLSSVSSFERFEIFPKESSWPNHTVTGVSASCSHNGKSSFY

RNLLWLTGKNGLYPNLSKSYVNNKEKEVLVLWGVHHPPNIGNQRALYHTE

NAYVSVVSSHYSRRFTPEIAKRPKVRDQEGRINYYWTLLEPGDTIIFEAN

GNLIAPWYAFALSRGFGSGIITS

SEQ ID NO: 19 NC HA1-3
NPENGTCYPGYFADYEELREQLSSVSSFERFEIFPKESSWPNHTVTGVSA

SCSHNGKSSFYRNLLWLTGKNGLYPNLSKSYVNNKEKEVLVLWGVHHPPN

IGNQRALYHTENAYVSVVSSHYSRRFTPEIAKRPKVRDQEGRINYYWTLL

EPGDTIIFEANGNLIAPWYAFALSRG

SEQ ID NO: 20 WIS HA1-1
QSSSTGGICDSPHQILDGENCTLIDALLGDPQCDGFQNKKWDLFVERSKA

YSNCYPYDVPDYASLRSLVASSGTLEFNDESFNWTGVTQNGTSSACKRRS

NNSFFSRLNWLTHLKFKYPALNVTMPNNEKFDKLYIWGVHHPGTDNDQIF

LHAQASGRITVSTKRSQQTVIPNIGSRPRIRNIPSRISIYWTIVKPGDIL

LINSTGNLIAPRGYFKIRSGKSSIMRSDAPIGKCNSECITPNGSIPNDKP

FQNVNRITYGACPRYVK

SEQ ID NO: 21 WIS HA1-2
SPHQILDGENCTLIDALLGDPQCDGFQNKKWDLFVERSKAYSNCYPYDVP

DYASLRSLVASSGTLEFNDESFNWTGVTQNGTSSACKRRSNNSFFSRLNW

LTHLKFKYPALNVTMPNNEKFDKLYIWGVHHPGTDNDQIFLHAQASGRIT

VSTKRSQQTVIPNIGSRPRIRNIPSRISIYWTIVKPGDILLINSTGNLIA

PRGYFKIRSGKSSIMRSD

SEQ ID NO: 22 WIS HA1-3
SNCYPYDVPDYASLRSLVASSGTLEFNDESFNWTGVTQNGTSSACKRRSN

NSFFSRLNWLTHLKFKYPALNVTMPNNEKFDKLYIWGVHHPGTDNDQIFL

HAQASGRITVSTKRSQQTVIPNIGSRPRIRNIPSRISIYWTIVKPGDILL

INSTGNLIAPRGYFKIRSG

SEQ ID NO: 23 A/Puerto Rico/8/34 HA0s
DTICIGYHANNSTDTVDTVLEKNVTVTHSVNLLEDSHNGKLCRLKGIAPL

QLGKCNIAGWLLGNPECDPLLPVRSWSYIVETPNSENGICYPGDFIDYEE

LREQLSSVSSFERFEIFPKESSWPNHNTNGVTAACSHEGKSSFYRNLLWL

TEKEGSYPKLKNSYVNKKGKEVLVLWGIHHPPNSKEQQNLYQNENAYVSV

VTSNYNRRFTPEIAERPKVRDQAGRMNYYWTLLKPGDTIIFEANGNLIAP

MYAFALSRGFGSGIITSNASMHECNTKCQTPLGAINSSLPYQNIHPVTIG

ECPKYVRSAKLRMVTGLRNIPSIQSRGLFGAIAGFIEGGWTGMIDGWYGY

HHQNEQGSGYAADQKSTQNAINGITNKVNTVIEKMNIQFTAVGKEFNKLE

KRMENLNKKVDDGFLDIWTYNAELLVLLENERTLDFHDSNVKNLYEKVKS

-continued

QLKNNAKEIGNGCFEFYHKCDNECMESVRNGTYDYPKYSEESKLNREKVD

GVKLESMGIYQ

SEQ ID NO: 24 PR/B HA1-2mut
KGAAPLQLGKCNIAGWLLGNPECDPLLPVRSWSDIAETPNSENGICYPGD

FIDYEELREQLSSVSSFERFEIFPKESSWPNHNTNGVTAACSHEGKSSFY

RNLLWLTEKEGSYPKLKNSYVNKKGKEVLVLWGIHHPPNSKEQQNLYQNE

NAYVSVVTSNYNRRFTPEIAERPKVRDQAGRMNYYWTLLKPGDTIIFEAN

GNLIAPMYAFALSRGFGSGIITS

SEQ ID NO: 25 PR/8 HA1-3mut
NSENEICYPGDFIDKEELREQLSSVSSFERFEIFPKESSWPNHNTNGVTA

ACSHEGKSSFYRNLLWLTEKEGSYPKLKNSYVNKKGKEVLVLWGIHHPPN

SKEQQNLYQNENAYVSVVTSNYNRRFTPEIAERPKVRDQAGRMNYYWTLL

KPGDTIIFEANGNLIAPMYAAALSRG

SEQ ID NO: 26 VN HA1-2mut
GAKPLSLRDCSVAGWLLGNPMCDEFINVPEWSDIAEKANPVNDLCYPGDF

NDYEELKHLLSRINHFEKIQIIPKSSWSSHEASLGVSSACPYQGKSSFFR

NVVWLIKKNSTYPTIKRSYNNTNQEDLLVLWGIHHPNDAAEQTKLYQNPT

TYISVGTSTLNQRLVPRIATRSKVNGQSGRMEFFWTILKPNDAINFESNG

NFIAPEYAYKIVKKGDSTIMKSE

SEQ ID NO: 27 VN HA1-3mut
NDLCYPGDFNDKEELKHLLSRINHFEKIQIIPKSSWSSHEASLGVSSACP

YQGKSSFFRNVVWLIKKNSTYPTIKRSYNNTNQEDLLVLWGIHHPNDAAE

QTKLYQNPTTYISVGTSTLNQRLVPRIATRSKVNGQSGRMEFFWTILKPN

DAINFESNGNFIAPEYAYKIAKKG

SEQ ID NO: 28 IND HA1-2mut
GAKPLSLRDCSVAGWLLGNPMCDEFINVPEWSDIAEKANPTNDLCYPGSF

NDYEELKHLLSRINHFEKIQIIPKSSWSDHEASSGVSSACPYLGSPSFFR

NVVWLIKKNSTYPTIKKSYNNTNQEDLLVLWGIHHPNDAAEQTRLYQNPT

TYISIGTSTLNQRLVPKIATRSKVNGQSGRMEFFWTILKPNDAINFESNG

NFIAPEYAYKIVKKGDSAIMKSE

SEQ ID NO: 29 IND HA1-3mut
NDLCYPGSFNDKEELKHLLSRINHFEKIQIIPKSSWSDHEASSGVSSACP

YLGSPSFFRNVVWLIKKNSTYPTIKKSYNNTNQEDLLVLWGIHHPNDAAE

QTRLYQNPTTYISIGTSTLNQRLVPKIATRSKVNGQSGRMEFFWTILKPN

DAINFESNGNFIAPEYAYKIAKKG

SEQ ID NO: 30 NC HA1-2mut
KGAAPLQLGNCSVAGWILGNPECELLISKESWSDIAETPNPENGTCYPGY

FADYEELREQLSSVSSFERFEIFPKESSWPNHTVTGVSASCSHNGKSSFY

RNLLWLTGKNGLYPNLSKSYVNNKEKEVLVLWGVHHPPNIGNQRALYHTE

NAYVSVVSSHYSRRFTPEIAKRPKVRDQEGRINYYWTLLEPGDTIIFEAN

GNLIAPWYAFALSRGFGSGIITS

SEQ ID NO: 31 NC HA1-3mut
NPENETCYPGYFADKEELREQLSSVSSFERFEIFPKESSWPNHTVTGVSA

SCSHNGKSSFYRNLLWLTGKNGLYPNLSKSYVNNKEKEVLVLWGVHHPPN

-continued

IGNQRALYHTENAYVSVVSSHYSRRFTPEIAKRPKVRDQEGRINYYWTLL

EPGDTIIFEANGNLIAPWYAAALSRG

SEQ ID NO: 32 WIS HA1-2mut
SPHQALDGENCTLIDALLGDPQCDGFQNKKWDDFAERSKAYSNCYPYDVP

DYASLRSLVASSGTLEFNDESFNWTGVTQNGTSSACKRRSNNSFFSRLNW

LTHLKFKYPALNVTMPNNEKFDKLYIWGVHHPGTDNDQIFLHAQASGRIT

VSTKRSQQTVIPNIGSRPRIRNIPSRISIYWTIVKPGDILLINSTGNLIA

PRGYFKIRSGKSSIMRSD

SEQ ID NO: 33 WIS HA1-3mut
SNCYPKDSPDEASLRSLVASSGTDEFNDESFNWTGVTQNGTSSACKRRSN

NSFFSRLNWLTHLKFKYPALNVTMPNNEKFDKLYIWGVHHPGTDNDQIFL

HAQASGRITVSTKRSQQTVIPNIGSRPRIRNIPSRISIYWTIVKPGDILL

INSTGNLIAPRGYFKIRSG

SEQ ID NO: 34 A/Swine/Hong Kong/9/98 HA
(ACCESSION BAB85618)
DKICIGYQSTNSTETVDTLTETNVPVTHAKELLHTEHNGMLCATNLGHPL

ILDTCTIEGLIYGNPSCDLLLGGREWSYIVERPSAVNGMCYPGNVENLEE

LRSLFSSASSYQRIQIFPDTIWNVSYSGTSKACSDSFYRSMRWLTQKNNA

YPIQDAQYTNNRGKSILFMWGINHPPTDTVQTNLYTRTDTTTSVTTEDIN

RTFKPVIGPRPLVNGLHGRIDYYWSVLKPGQTLRVRSNGNLIAPWYGHIL

SGESHGRILKTDLNSGNCVVQCQTERGGLNTTLPFHNVSKYAFGNCPKYV

GVKSLKLAVGLRNVPARSSR

SEQ ID NO: 35 A/Aichi/2/1968 HA
(ACCESSION BAF37221)
MKTIIALSYIFCLALGQDLPGNDNSTATLCLGHHAVPNGTLVKTITDDQI

EVTNATELVQSSSTGKICNNPHRILDGIDCTLIDALLGDPHCDVFQNETW

DLFVERSKAFSNCYPYDVPDYASLRSLVASSGTLEFITEGFTWTGVTQNG

GSNACKRGPGSGFFSRLNWLTKSGSTYPVLNVTMPNNDNFDKLYIWGIIH

HPSTNQEQTSLYVQASGRVTVSTRRSQQTIIPNIGSRPWVRGLSSRISIY

WTIVKPGDVLVINSNGNLIAPRGYFKMRTGKSSIMRSDAPIDTCISECIT

PNGSIPNDKPFQNVNKITYGACPKYVKQNTLKLLATGMRNVPEKQTRGLF

GAIAGFIENGWEGMIDGWYGFRHQNSEGTGQAADLKSTQAAIDQINGKLN

RVIEKTNEKFHQIEKEFSEVEGRIQDLEKYVEDTKIDLWSYNAELLVALE

NQHTIDLTDSEMNKLFEKTRRQLRENAEEMGNGCFKIYHKCDNACIESIR

NGTYDHDVYRDEALNNRFQIKGVELKSGYKDWILWISFAISCFLLCVVLL

GFIMWACQRGNIRCNICI

SEQ ID NO: 36 B/Lee/40 HA
(Accession NP_056660)
MKAIIVLLMVVTSNADRICTGITSSNSPHVVKTATQGEVNVTGVIPLTTT

PTKSHFANLKGTQTRGKLCPNCFNCTDLDVALGRPKCMGNTPSAKVSILH

EVKPATSGCFPIMHDRTKIRQLPNLLRGYENIRLSTSNVINTETAPGGPY

KVGTSGSCPNVANGNGFFNTMAWVIPKDNNKTAINPVTVEVPYICSEGED

QITVWGFHSDDKTQMERLYGDSNPQKFTSSANGVTTHYVSQIGGFPNQTE

DEGLKQSGRIVVDYMVQKPGKTGTIVYQRGILLPQKVWCASGRSKVIKGS

LPLIGEADCLHEKYGGLNKSKPYYTGEHAKAIGNCPIWVKTPLKLANGTK

-continued

YRPPAKLLKERGFFGAIAGFLEGGWEGMIAGWHGYTSHGAHGVAVAADLK

STQEAINKITKNLNYLSELEVKNLQRLSGAMNELHDEILELDEKVDDLRA

DTISSQIELAVLLSNEGIINSEDEHLLALERKLKKMLGPSAVEIGNGCFE

TKHKCNQTCLDRIAAGTFNAGDFSLPTFDSLNITAASLNDDGLDNHTILL

YYSTAASSLAVTLMIAIFIVYMVSRDNVSCSICL

SEQ ID NO: 37 C/Johannesburg/1/66
(ACCESSION AAW73083)
MFFSLLLVLGLTEAEKIKICLQKQVNSSFSLHNGFGGNLYATEEKRMFEL

VKPKAGASVLNQSTWIGFGDSRTDKSNSAFPRSADVSAKTADKFRSLSGG

SLMLSMFGPPGKVDYLYQGCGKHKVFYEGVNWSPHAAINCYRKNWTDIKL

NFQKNIYELASQSHCMSLVNALDKTIPLQVTAGTAGNCNNSFLKNPALYT

QEVKPSENKCGKENLAFFTLPTQFGTYECKLHLVASCYFIYDSKEVYNKR

GCDNYFQVIYDSSGKVVGGLDNRVSPYTGNSGDTPTMQCDMLQLKPGRYS

VRSSPRFLLMPERSYCFDMKEKGPVTAVQSIWGKGRESDYAVDQACLSTP

GCMLIQKQKPYIGEADDHHGDQEMRELLSGLDYEARCISQSGWVNETSPF

TEKYLLPPKFGRCPLAAKEESIPKIPDGLLIPTSGTDTTVTKPKSRIFGI

DDLIIGLLFVAIVEAGIGGYLLGSRKESGGGVTKESAEKGFEKIGNDIQI

LKSSINIAIEKLNDRISHDEQAIRDLTLEIENARSEALLGELGIIRALLV

GNISIGLQESLWELASEITNRAGDLAVEVSPGCWIIDNNICDQSCQNFIF

KFNETAPVPTIPPLDTKIDLQSDPFYWGSSLGLAITATISLAALVISGIA

ICRTK

SEQ ID NO: 38 B/Lee/40 HA1-1
TTTPTKSHFANLKGTQTRGKLCPNCFNCTDLDVALGRPKCMGNTPSAKVS

ILHEVKPATSGCFPIMHDRTKIRQLPNLLRGYENIRLSTSNVINTETAPG

GPYKVGTSGSCPNVANGNGFFNTMAWVIPKDNNKTAINPVTVEVPYICSE

GEDQITVWGFHSDDKTQMERLYGDSNPQKFTSSANGVTTHYVSQIGGFPN

QTEDEGLKQSGRIVVDYMVQKPGKTGTIVYQRGILLPQKVWCASGRSKVI

KGSLPLIGEADCLHEKYGGLNKSKPYYTGEHAKAIGNCPIWVK

SEQ ID NO: 39 B/Lee/40 HA1-2
KGTQTRGKLCPNCFNCTDLDVALGRPKCMGNTPSAKVSILHEVKPATSGC

FPIMHDRTKIRQLPNLLRGYENIRLSTSNVINTETAPGGPYKVGTSGSCP

NVANGNGFFNTMAWVIPKDNNKTAINPVTVEVPYICSEGEDQITVWGFHS

DDKTQMERLYGDSNPQKFTSSANGVTTHYVSQIGGFPNQTEDEGLKQSGR

IVVDYMVQKPGKTGTIVYQRGILLPQKVWCASGRSKVIKG

SEQ ID NO: 40 A/Aichi/2/68 HA1-1
QSSSTGKICNNPHRILDGIDCTLIDALLGDPHCDVFQNETWDLFVERSKA

FSNCYPYDVPDYASLRSLVASSGTLEFITEGFTWTGVTQNGGSNACKRGP

GSGFFSRLNWLTKSGSTYPVLNVTMPNNDNFDKLYIWGIHHPSTNQEQTS

LYVQASGRVTVSTRRSQQTIIPNIGSRPWVRGLSSRISIYWTIVKPGDVL

VINSNGNLIAPRGYFKMRTGKSSIMRSDAPIDTCISECITPNGSIPNDKP

FQNVNKITYGACPKYVK

-continued

SEQ ID NO: 41 A/Aichi/2/68 HA1-2
HRILDGIDCTLIDALLGDPHCDVFQNETWDLFVERSKAFSNCYPYDVPDY

ASLRSLVASSGTLEFITEGFTWTGVTQNGGSNACKRGPGSGFFSRLNWLT

KSGSTYPVLNVTMPNNDNFDKLYIWGIHHPSTNQEQTSLYVQASGRVTVS

TRRSQQTIIPNIGSRPWVRGLSSRISIYWTIVKPGDVLVINSNGNLIAPR

GYFKMRTGKSSIMRSD

SEQ ID NO: 42 B/Malaysia/2506/2004 HA
(Accession ISDN126672)
IVLLMVVTSNADRICTGITSSNSPHVVKTATQGEVNVTGVIPLTTTPTKS

HFANLKGTETRGKLCPKCLNCTDLDVALGRPKCTGNIPSARVSILHEVRP

VTSGCFPIMHDRTKIRQLPNLLRGYEHIRLSTHNVINAENAPGGSYKIGT

SGSCPNVTNGNGFFATMAWAVPKNDNNKTATNSLTIEVPYICTEGEDQIT

VWGFHSDNEAQMAKLYGDSKPQKFTSSANGVTTHYVSQIGGFPNQTEDGG

LPQSGRIVVDYMVQKSGKTGTITYQRGILLPQKVWCASGRSKVIKGSLPL

IGEADCLHEKYGGLNKSKPYYTGEHAKAIGNCPIWVKTPLKLANGTKYRP

PAKLLKER

SEQ ID NO: 43 B/Ohio/1/2005 HA
(Accession ISDN133312)
DRICTGITSSNSPHVVKTATQGEVNVTGVIPLTTTPTKSHFANLKGTKTR

GKLCPKCLNCTDLDVALGRPKCTGNIPSAEVSILHEVRPVTSGCFPIMHD

RTKIRQLPNLLRGYEHIRLSTHNVINAEKAPGGPYKIGTSGSCPNVTNGN

GFFATMAWAVPKNDNNKTATNSLTIEVPYICTEGEDQITIWGFHSDSETQ

MAKLYGDSKPQKFTSSANGVTTHYVSQIGGFPNQTEDGGLPQSGRIVVDY

MVQKSGKTGTITYQRGILLPQKVWCASGRSKVIKGSLPLIGEADCLHEKY

GGLNKSKPYYTGEHAKAIGNCPIWVKTPLKLANGTKYRPPAKLLKERGF

SEQ ID NO: 44 B/Shanghai/361/2002 HA
(Accession ISDN80784)
DRICTGITSSNSPHVVKTATQGEVNVTGVIPLTTTPIKSHFANLKGTRTR

GKLCPDCLNCTDLDVALGRPMCVGTTPSAKASILHEVRPVTSGCFPIMHD

RTKIRQLPNLLRGYENIRLSTQNVIDAEKALGGPYRLGTSGSCPNATSKS

GFFATMAWAVPKDNNKNATNPLTVEVPYICTEGEDQITVWGFHSDDKTQM

KNLYGDSNPQKFTSSANGVTTHYVSQIGGFPDQTEDGGLPQSGRIVVDYM

VQKPGKTGTIVYQRGVLLPQKVWCASGRSKVIKGSLPLIGEADCLHEKYG

GLNKSKPYYTGEHAKAIGHCPIWVKTPLKLANGTKYRP

SEQ ID NO: 45 B/Malaysia/2506/2004 HA1-1
TTTPTKSHFANLKGTETRGKLCPKCLNCTDLDVALGRPKCTGNIPSARVS

ILHEVRPVTSGCFPIMHDRTKIRQLPNLLRGYEHIRLSTHNVINAENAPG

GSYKIGTSGSCPNVTNGNGFFATMAWAVPKNDNNKTATNSLTIEVPYICT

EGEDQITVWGFHSDNEAQMAKLYGDSKPQKFTSSANGVTTHYVSQIGGFP

NQTEDGGLPQSGRIVVDYMVQKSGKTGTITYQRGILLPQKVWCASGRSKV

IKGSLPLIGEADCLHEKYGGLNKSKPYYTGEHAKAIGNCPIWVK

SEQ ID NO: 46 B/Malaysia/2506/2004 HA1-2
KGTETRGKLCPKCLNCTDLDVALGRPKCTGNIPSARVSILHEVRPVTSGC

FPIMHDRTKIRQLPNLLRGYEHIRLSTHNVINAENAPGGSYKIGTSGSCP

NVTNGNGFFATMAWAVPKNDNNKTATNSLTIEVPYICTEGEDQITVWGFH

-continued

SDNEAQMAKLYGDSKPQKFTSSANGVTTHYVSQIGGFPNQTEDGGLPQSG

RIVVDYMVQKSGKTGTITYQRGILLPQKVWCASGRSKVIKG

SEQ ID NO: 47 B/Ohio/1/2005 HA1-1
TTTPTKSHFANLKGTKTRGKLCPKCLNCTDLDVALGRPKCTGNIPSAEVS

ILHEVRPVTSGCFPIMHDRTKIRQLPNLLRGYEHIRLSTHNVINAEKAPG

GPYKIGTSGSCPNVTNGNGFFATMAWAVPKNDNNKTATNSLTIEVPYICT

EGEDQITIWGFHSDSETQMAKLYGDSKPQKFTSSANGVTTHYVSQIGGFP

NQTEDGGLPQSGRIVVDYMVQKSGKTGTITYQRGILLPQKVWCASGRSKV

IKGSLPLIGEADCLHEKYGGLNKSKPYYTGEHLAKAIGNCPIWVK

SEQ ID NO: 48 B/Ohio/1/2005 HA1-2
KGTKTRGKLCPKCLNCTDLDVALGRPKCTGNIPSAEVSILHEVRPVTSGC

FPIMHDRTKIRQLPNLLRGYEHIRLSTHNVINAEKAPGGPYKIGTSGSCP

NVTNGNGFFATMAWAVPKNDNNKTATNSLTIEVPYICTEGEDQITIWGFH

SDSETQMAKLYGDSKPQKFTSSANGVTTHYVSQIGGFPNQTEDGGLPQSG

RIVVDYMVQKSGKTGTITYQRGILLPQKVWCASGRSKVIKG

SEQ ID NO: 49 B/Shanghai/361/2002 HA1-1
TTTPIKSHFANLKGTRTRGKLCPDCLNCTDLDVALGRPMCVGTTPSAKAS

ILHEVRPVTSGCFPIMHDRTKIRQLPNLLRGYENIRLSTQNVIDAEKALG

GPYRLGTSGSCPNATSKSGFFATMAWAVPKDNNKNATNPLTVEVPYICTE

GEDQITVWGFHSDDKTQMKNLYGDSNPQKFTSSANGVTTHYVSQIGGFPD

QTEDGGLPQSGRIVVDYMVQKPGKTGTIVYQRGVLLPQKVWCASGRSKVI

KGSLPLIGEADCLHEKYGGLNKSKPYYTGEHAKAIGHCPIWVK

SEQ ID NO: 50 B/Shanghai/361/2002 HA1-2
KGTRTRGKLCPDCLNCTDLDVALGRPMCVGTTPSAKASILHEVRPVTSGC

FPIMHDRTKIRQLPNLLRGYENIRLSTQNVIDAEKALGGPYRLGTSGSCP

NATSKSGFFATMAWAVPKDNNKNATNPLTVEVPYICTEGEDQITVWGFHS

DDKTQMKNLYGDSNPQKFTSSANGVTTHYVSQIGGFPDQTEDGGLPQSGR

IVVDYMVQKPGKTGTIVYQRGVLLPQKVWCASGRSKVIKG

SEQ ID NO: 51 STF2.blp
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

-continued

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGAGCCTGTTACGT

SEQ ID NO: 52 STF2.SG
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

-continued

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGTCTCTGTTACGTAGCGGCAGTGGTAGCGGATCC

SEQ ID NO: 53 STF2.HA1-1 PR8

ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACCACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTTTGC

AGCAGGCCGGTACTTCCGTTCTGGCGCAGGCTAACCAGGTCCCGCAGAAC

GTGCTGTCTCTGTTACGTAGCGGCAGTGGTAGCGGATCCTCTCATAACGG

TAAACTGTGTCGTCTGAAAGGTATTGCACCACTGCAGCTGGGCAAATGCA

-continued

ACATCGCGGGTTGGCTGCTGGGTAACCCTGAATGTGACCCGCTGCTGCCG

GTTCGTTCCTGGAGCTACATTGTTGAAACCCCGAACTCCGAAAACGGTAT

CTGCTACCCGGGCGACTTTATTGACTATGAAGAACTGCGTGAGCAGCTGT

CTTCCGTGAGCAGCTTTGAACGCTTCGAAATCTTCCCGAAGGAAAGCTCC

TGGCCGAACCACAACACTAACGGCGTGACGGCGGCTTGCTCCCACGAAGG

CAAATCTTCCTTTTATCGTAACCTGCTGTGGCTGACTGAAAAGGAAGGTT

CCTACCCAAAACTGAAAAACAGCTATGTTAACAAAAAGGGTAAAGAAGTC

CTGGTGCTGTGGGGCATCCACCACCCGCCGAACTCCAAGGAACAGCAGAA

TCTGTATCAGAACGAAAACGCATACGTTTCTGTCGTTACTTCCAACTATA

ACCGTCGTTTCACTCCGGAAATCGCGGAACGTCCGAAAGTACGCGACCAG

GCTGGCCGTATGAACTACTACTGGACCCTGCTGAAACCGGGTGACACTAT

TATCTTCGAAGCTAACGGTAACCTGATCGCACCAATGTACGCTTTCGCAC

TGTCTCGTGGTTTCGGTTCCGGCATTATCACCAGCAACGCGTCTATGCAC

GAATGCAACACGAAATGTCAGACGCCGCTGGGCGCAATTAATAGCAGCCT

GCCGTACCAGAACATCCACCCGGTGACTATCGGCGAATGCCCGAAGTATG

TTCGTTAATAG

SEQ ID NO: 54 STF2.HA1-1.his PR8

ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGCTT

ATGCGCTTAAAGCTGGCGATAAGTATTACGCCGCAGATTACGATGAAGCG

ACAGGAGCAATTAAAGCTAAAACCACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

-continued

GATTTCAAAGCACAACCAGAGCTGGCGGAAGCAGCCGCTAAAACCACCGA

AAACCCGCTGCAAAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTTTGC

AGCAGGCCGGTACTTCCGTTCTGGCGCAGGCTAACCAGGTCCCGCAGAAC

GTGCTGTCTCTGTTACGTAGCGGCAGTGGTAGCGGATCCTCTCATAACGG

TAAACTGTGTCGTCTGAAAGGTATTGCACCACTGCAGCTGGGCAAATGCA

ACATCGCGGGTTGGCTGCTGGGTAACCCTGAATGTGACCCGCTGCTGCCG

GTTCGTTCCTGGAGCTACATTGTTGAAACCCCGAACTCCGAAAACGGTAT

CTGCTACCCGGGCGACTTTATTGACTATGAAGAACTGCGTGAGCAGCTGT

CTTCCGTGAGCAGCTTTGAACGCTTCGAAATCTTCCCGAAGGAAAGCTCC

TGGCCGAACCACAACACTAACGGCGTGACGGCGGCTTGCTCCCACGAAGG

CAAATCTTCCTTTTATCGTAACCTGCTGTGGCTGACTGAAAAGGAAGGTT

CCTACCCAAAACTGAAAAACAGCTATGTTAACAAAAAGGGTAAAGAAGTC

CTGGTGCTGTGGGGCATCCACCACCCGCCGAACTCCAAGGAACAGCAGAA

TCTGTATCAGAACGAAAACGCATACGTTTCTGTCGTTACTTCCAACTATA

ACCGTCGTTTCACTCCGGAAATCGCGGAACGTCCGAAAGTACGCGACCAG

GCTGGCCGTATGAACTACTACTGGACCCTGCTGAAACCGGGTGACACTAT

TATCTTCGAAGCTAACGGTAACCTGATCGCACCAATGTACGCTTTCGCAC

TGTCTCGTGGTTTCGGTTCCGGCATTATCACCAGCAACGCGTCTATGCAC

GAATGCAACACGAAATGTCAGACGCCGCTGGGCGCAATTAATAGCAGCCT

GCCGTACCAGAACATCCACCCGGTGACTATCGGCGAATGCCCGAAGTATG

TTCGTCATCACCATCATCACCATTAATAG

SEQ ID NO: 55 STF2.HA1-2 PR8
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

-continued

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGTCTCTGTTACGTTCTGGTTCTGGTTCTGGTTCTAAAGGTATTGC

TCCACTGCAACTGGGTAAATGCAATATTGCGGGTTGGCTGCTGGGCAACC

CGGAATGCGATCCGCTGCTGCCGGTCCGTTCCTGGAGCTATATTGTTGAA

ACTCCGAACTCTGAGAACGGCATCTGCTATCCAGGTGATTTCATTGACTA

TGAGGAACTGCGTGAACAACTGTCTTCCGTGTCTTCCTTTGAACGTTTCG

AGATTTTTCCTAAAGAATCTTCTTGGCCGAACCATAACACTAATGGTGTT

ACCGCTGCGTGCTCTCATGAAGGTAAATCTAGCTTTTACCGCAACCTGCT

GTGGCTGACCGAGAAAGAAGGTTCTTACCCGAAACTGAAAAACAGCTACG

TAAACAAAAAGGGCAAGGAAGTTCTGGTCCTGTGGGGTATCCACCATCCG

CCGAACAGCAAGGAACAGCAGAATCTGTATCAGAACGAAAACGCATACGT

ATCTGTTGTTACTTCTAACTACAACCGCCGTTTCACCCCTGAAATCGCGG

AACGTCCGAAAGTGCGTGACCAGGCAGGCCGCATGAACTATTACTGGACC

CTGCTGAAGCCGGGTGATACTATCATCTTCGAAGCGAACGGTAACCTGAT

CGCCCCGATGTACGCGTTCGCTCTGAGCCGTGGCTTCGGCTCTGGTATCA

TTACGTCTTAATAA

SEQ ID NO: 56 STF2.HA1-2mut PR8
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

-continued

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACCACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTTTGC

AGCAGGCCGGTACTTCCGTTCTGGCGCAGGCTAACCAGGTCCCGCAGAAC

GTGCTGTCTCTGTTAGCGAGCGGCAGTGGTAGCGGATCCAAAGGTGCGGC

TCCACTGCAACTGGGTAAATGCAATATTGCGGGTTGGCTGCTGGGCAACC

CGGAATGCGATCCGCTGCTGCCGGTCCGTTCCTGGAGCGATATTGCGGAA

ACTCCGAACTCTGAGAACGGCATCTGCTATCCAGGTGATTTCATTGACTA

TGAGGAACTGCGTGAACAACTGTCTTCCGTGTCTTCCTTTGAACGTTTCG

AGATTTTTCCTAAAGAATCTTCTTGGCCGAACCATAACACTAATGGTGTT

ACCGCTGCGTGCTCTCATGAAGGTAAATCTAGCTTTTACCGCAACCTGCT

GTGGCTGACCGAGAAAGAAGGTTCTTACCCGAAACTGAAAAACAGCTACG

TAAACAAAAAGGGCAAGGAAGTTCTGGTCCTGTGGGGTATCCACCATCCG

CCGAACAGCAAGGAACAGCAGAATCTGTATCAGAACGAAAACGCATACGT

ATCTGTTGTTACTTCTAACTACAACCGCCGTTTCACCCCTGAAATCGCGG

AACGTCCGAAAGTGCGTGACCAGGCAGGCCGCATGAACTATTACTGGACC

CTGCTGAAGCCGGGTGATACTATCATCTTCGAAGCGAACGGTAACCTGAT

CGCCCCGATGTACGCGTTCGCTCTGAGCCGTGGCTTCGGCTCTGGTATCA

TTACGTCTTAATAA

SEQ ID NO: 57 STF2.HA1-3 PR8
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

-continued

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACCAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGTCTCTGTTACGTTCTGGTAGCGGTTCTGGCTCTAACTCTGAAAA

TGGTATCTGTTACCCGGGTGATTTCATCGATTATGAGGAACTGCGTGAAC

AGCTGTCTAGCGTGAGCTCCTTTGAACGCTTCGAAATCTTCCCGAAGGAA

TCTAGCTGGCCGAACCATAACACGAACGGTGTGACCGCTGCTTGCTCCCA

CGAAGGTAAGAGCTCCTTCTACCGCAATCTGCTGTGGCTGACTGAAAAAG

AAGGTAGCTACCCGAAACTGAAAAATTCTTACGTCAACAAGAAAGGCAAG

GAAGTGCTGGTTCTGTGGGGCATTCACCACCCACCGAACAGCAAAGAGCA

ACAGAACCTGTACCAAAATGAGAACGCTTACGTTTCTGTTGTGACTTCTA

ACTACAATCGTCGCTTTACCCCTGAAATCGCGGAGCGTCCAAAAGTGCGT

GACCAGGCTGGTCGTATGAACTACTATTGGACCCTGCTGAAACCGGGCGA

CACCATTATCTTTGAAGCGAACGGTAACCTGATCGCGCCTATGTACGCGT

TCGCTCTGTCTCGTGGCTAATAA

SEQ ID NO: 58 STF2.HA1-3mut PR8
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

-continued

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGTCTCTGTTACGTAGCGGCAGTGGTAGCGGATCCAACTCTGAAAA

TGAAATCTGTTACCCGGGTGATTTCATCGATAAAGAGGAACTGCGTGAAC

AGCTGTCTAGCGTGAGCTCCTTTGAACGCTTCGAAATCTTCCCGAAGGAA

TCTAGCTGGCCGAACCATAACACGAACGGTGTGACCGCTGCTTGCTCCCA

CGAAGGTAAGAGCTCCTTCTACCGCAATCTGCTGTGGCTGACTGAAAAAG

AAGGTAGCTACCCGAAACTGAAAAATTCTTACGTCAACAAGAAAGGCAAG

GAAGTGCTGGTTCTGTGGGGCATTCACCACCCACCGAACAGCAAAGAGCA

ACAGAACCTGTACCAAAATGAGAACGCTTACGTTTCTGTTGTGACTTCTA

ACTACAATCGTCGCTTTACCCCTGAAATCGCGGAGCGTCCAAAAGTGCGT

GACCAGGCTGGTCGTATGAACTACTATTGGACCCTGCTGAAACCGGGCGA

CACCATTATCTTTGAAGCGAACGGTAACCTGATCGCGCCTATGTACGCGG

CGGCTCTGTCTCGTGGCTAATAA

SEQ ID NO: 59 HA1-1 PR8
ATGTCTCATAACGGTAAACTGTGTCGTCTGAAAGGTATTGCACCACTGCA

GCTGGGCAAATGCAACATCGCGGGTTGGCTGCTGGGTAACCCTGAATGTG

-continued

ACCCGCTGCTGCCGGTTCGTTCCTGGAGCTACATTGTTGAAACCCCGAAC

TCCGAAAACGGTATCTGCTACCCGGGCGACTTTATTGACTATGAAGAACT

GCGTGAGCAGCTGTCTTCCGTGAGCAGCTTTGAACGCTTCGAAATCTTCC

CGAAGGAAAGCTCCTGGCCGAACCACAACACTAACGGCGTGACGGCGGCT

TGCTCCCACGAAGGCAAATCTTCCTTTTATCGTAACCTGCTGTGGCTGAC

TGAAAAGGAAGGTTCCTACCCAAAACTGAAAAACAGCTATGTTAACAAAA

AGGGTAAAGAAGTCCTGGTGCTGTGGGGCATCCACCACCCGCCGAACTCC

AAGGAACAGCAGAATCTGTATCAGAACGAAAACGCATACGTTTCTGTCGT

TACTTCCAACTATAACCGTCGTTTCACTCCGGAAATCGCGGAACGTCCGA

AAGTACGCGACCAGGCTGGCCGTATGAACTACTACTGGACCCTGCTGAAA

CCGGGTGACACTATTATCTTCGAAGCTAACGGTAACCTGATCGCACCAAT

GTACGCTTTCGCACTGTCTCGTGGTTTCGGTTCCGGCATTATCACCAGCA

ACGCGTCTATGCACGAATGCAACACGAAATGTCAGACGCCGCTGGGCGCA

ATTAATAGCAGCCTGCCGTACCAGAACATCCACCCGGTGACTATCGGCGA

ATGCCCGAAGTATGTTCGT

SEQ ID NO: 60 HA1-1.his PR8
ATGTCTCATAACGGTAAACTGTGTCGTCTGAAAGGTATTGCACCACTGCA

GCTGGGCAAATGCAACATCGCGGGTTGGCTGCTGGGTAACCCTGAATGTG

ACCCGCTGCTGCCGGTTCGTTCCTGGAGCTACATTGTTGAAACCCCGAAC

TCCGAAAACGGTATCTGCTACCCGGGCGACTTTATTGACTATGAAGAACT

GCGTGAGCAGCTGTCTTCCGTGAGCAGCTTTGAACGCTTCGAAATCTTCC

CGAAGGAAAGCTCCTGGCCGAACCACAACACTAACGGCGTGACGGCGGCT

TGCTCCCACGAAGGCAAATCTTCCTTTTATCGTAACCTGCTGTGGCTGAC

TGAAAAGGAAGGTTCCTACCCAAAACTGAAAAACAGCTATGTTAACAAAA

AGGGTAAAGAAGTCCTGGTGCTGTGGGGCATCCACCACCCGCCGAACTCC

AAGGAACAGCAGAATCTGTATCAGAACGAAAACGCATACGTTTCTGTCGT

TACTTCCAACTATAACCGTCGTTTCACTCCGGAAATCGCGGAACGTCCGA

AAGTACGCGACCAGGCTGGCCGTATGAACTACTACTGGACCCTGCTGAAA

CCGGGTGACACTATTATCTTCGAAGCTAACGGTAACCTGATCGCACCAAT

GTACGCTTTCGCACTGTCTCGTGGTTTCGGTTCCGGCATTATCACCAGCA

ACGCGTCTATGCACGAATGCAACACGAAATGTCAGACGCCGCTGGGCGCA

ATTAATAGCAGCCTGCCGTACCAGAACATCCACCCGGTGACTATCGGCGA

ATGCCCGAAGTATGTTCGTCATCACCATCATCACCAT

SEQ ID NO: 61 HA1-2.his PR8
ATGAAAGGTATTGCTCCACTGCAACTGGGTAAATGCAATATTGCGGGTTG

GCTGCTGGGCAACCCGGAATGCGATCCGCTGCTGCCGGTCCGTTCCTGGA

GCTATATTGTTGAAACTCCGAACTCTGAGAACGGCATCTGCTATCCAGGT

GATTTCATTGACTATGAGGAACTGCGTGAACAACTGTCTTCCGTGTCTTC

CTTTGAACGTTTCGAGATTTTTCCTAAAGAATCTTCTTGGCCGAACCATA

ACACTAATGGTGTTACCGCTGCGTGCTCTCATGAAGGTAAATCTAGCTTT

TACCGCAACCTGCTGTGGCTGACCGAGAAAGAAGGTTCTTACCCGAAACT

GAAAAACAGCTACGTAAACAAAAAGGGCAAGGAAGTTCTGGTCCTGTGGG

-continued

GTATCCACCATCCGCCGAACAGCAAGGAACAGCAGAATCTGTATCAGAAC

GAAAACGCATACGTATCTGTTGTTACTTCTAACTACAACCGCCGTTTCAC

CCCTGAAATCGCGGAACGTCCGAAAGTGCGTGACCAGGCAGGCCGCATGA

ACTATTACTGGACCCTGCTGAAGCCGGGTGATACTATCATCTTCGAAGCG

AACGGTAACCTGATCGCCCCGATGTACGCGTTCGCTCTGAGCCGTGGCTT

CGGCTCTGGTATCATTACGTCTCATCACCATCATCACCAT

SEQ ID NO: 62 CRM.HA1-2
ATGGGTGCTGATGATGTCGTTGATTCCTCCAAAAGCTTCGTTATGGAAAA

TTTCTCTTCTTATCACGGCACCAAACCGGGTTATGTGGATTCTATCCAAA

AAGGCATCCAGAAACCGAAGTCCGGTACGCAGGGTAACTATGATGACGAT

TGGAAAGGTTTTTACTCCACCGATAATAAATATGACGCGGCTGGCTACTC

TGTTGACAACGAAAATCCACTGTCTGGTAAGGCTGGCGGTGTCGTAAAGG

TAACGTATCCTGGCCTGACCAAGGTGCTGGCACTGAAGGTGGATAACGCT

GAAACCATCAAAAAGGAGCTGGGCCTGAGCCTGACTGAACCGCTGATGGA

GCAGGTCGGTACCGAGGAATTCATCAAACGCTTCGGTGATGGCGCCTCCC

GTGTTGTGCTGTCCCTGCCGTTCGCAGAAGGCTCTTCCTCTGTCGAATAT

ATCAACAACTGGGAACAGGCTAAAGCTCTGAGCGTCGAACTGGAAATTAA

CTTTGAGACCCGTGGCAAGCGTGGTCAGGACGCGATGTACGAATATATGG

CTCAGGCTTGTGCCGGTAACCGTGTTCGCCGTTCCGTCGGTTCCTCTCTG

TCTTGCATCAACCTGGATTGGGACGTTATCCGTGATAAGACCAAAACCAA

AATTGAAAGCCTGAAGGAACACGGTCCGATCAAAAACAAAATGTCTGAAT

CTCCGAACAAAACCGTGTCCGAGGAAAAAGCGAAACAGTATCTGGAAGAA

TTCCACCAGACTGCCCTGGAACATCCTGAACTGTCCGAACTGAAGACTGT

AACCGGCACTAACCCGGTGTTCGCAGGCGCAAACTACGCCGCGTGGGCGG

TAAACGTTGCGCAGGTTATTGATAGCGAAACCGCAGATAACCTGGAAAAA

ACGACCGCAGCTCTGTCTATCCTGCCGGGTATCGGTTCCGTTATGGGTAT

TGCGGACGGCGCTGTGCACCACAACACGGAAGAAATCGTCGCACAGTCTA

TCGCGCTGTCTTCTCTGATGGTTGCTCAGGCAATTCCACTGGTAGGTGAA

CTGGTGGACATTGGCTTTGCGGCGTACAACTTCGTCGAAAGCATTATCAA

CCTGTTCCAGGTTGTACACAACTCTTACAACCGTCCGGCCTACAGCCCTG

GCCACAAAACCCAACCGTTTCTGCACGACGGTTATGCGGTGTCCTGGAAC

ACGGTTGAAGACTCTATCATTCGTACCGGCTTTCAGGGCGAGTCCGGCCA

CGATATCAAAATTACTGCAGAAAACACTCCGCTGCCGATCGCTGGCGTTC

TGCTGCCGACCATCCCGGGTAAGCTGGATGTGAACAAAAGCAAAACCCAC

ATCTCTGTTAACGGTCGTAAAATTCGCATGCGCTGTCGTGCTATCGACGG

TGATGTTACCTTCTGCCGTCCGAAATCTCCAGTCTACGTGGGCAACGGTG

TTCATGCCAACCTGCACGTGGCGTTCCATCGTAGCTCTAGCGAAAAAATC

CACTCCAACGAAATCTCTAGCGATTCTATCGGTGTTCTGGGTTATCAGAA

AACGGTGGATCATACGAAAGTCAATTCTAAACTGAGCCTGTTCTTCGAAA

TCAAATCTAGCGGCTCTGGATCCGGTTCCAAAGGCATCGCGCCGCTGCAG

CTGGGTAAATGTAACATTGCGGGCTGGCTGCTGGGTAATCCGGAATGCGA

-continued

TCCGCTGCTGCCGGTCCGTAGCTGGTCTTACATTGTTGAAACTCCGAACT

CTGAGAATGGCATCTGCTACCCGGGCGATTTTATCGACTATGAAGAACTG

CGTGAACAGCTGTCTTCCGTTTCTTCCTTTGAACGTTTCGAAATCTTCCC

GAAAGAAAGCAGCTGGCCGAATCACAATACGAACGGTGTTACTGCTGCGT

GTTCTCATGAAGGTAAATCCAGCTTCTACCGTAACCTGCTGTGGCTGACC

GAAAAAGAGGGTTCTTATCCTAAACTGAAAAACAGCTACGTTAACAAAAA

GGGCAAAGAAGTGCTGGTGCTGTGGGGTATCCATCACCCTCCGAACTCTA

AAGAACAACAGAATCTGTATCAQAACGAAAACGCTTACGTTTCCGTGGTG

ACCTCTAACTATAACCGTCGTTTTACCCCGGAGATTGCTGAACGTCCGAA

AGTGCGCGATCAGGCTGGCCGTATGAACTACTATTGGACCCTGCTGAAAC

CGGGCGATACCATCATTTTCGAAGCTAACGGCAACCTGATTGCTCCGATG

TATGCGTTTGCTCTGTCTCGTGGCTTCGGCTCTGGTATTATTACGTCTTA

ATAA

SEQ ID NO: 63 LTB.HA1-2
ATGAATAAGGTTAAGTTCTACGTACTGTTTACCGCGCTGCTGTCTTCTCT

GTGCGCGCATGGTGCTCCGCAGTCTATTACTGAACTGTGCTCTGAATACC

ACAACACCCAGATCTATACTATCAACGATAAAATCCTGAGCTATACCGAA

TCTATGGCAGGCAAACGCGAAATGGTTATCATTACCTTTAAAAGCGGCGC

CACCTTTCAAGTGGAAGTTCCGGGCTCTCAGCATATTGACTCTCAAAAAA

AAGCGATCGAACGTATGAAAGATACTCTGCGCATTACCTACCTGACCGAA

ACCAAAATCGATAAACTGTGCGTATGGAACAATAAGACTCCTAACTCTAT

CGCAGCTATTTCTATGGAAAACTCTGGTAGCGGATCCGGTTCTAAAGGCA

TCGCGCCGCTGCAGCTGGGTAAATGTAACATTGCGGGCTGGCTGCTGGGT

AATCCGGAATGCGATCCGCTGCTGCCGGTCCGTAGCTGGTCTTACATTGT

TGAAACTCCGAACTCTGAGAATGGCATCTGCTACCCGGGCGATTTTATCG

ACTATGAAGAACTGCGTGAACAGCTGTCTTCCGTTTCTTCCTTTGAACGT

TTCGAAATCTTCCCGAAAGAAAGCAGCTGGCCGAATCACAATACGAACGG

TGTTACTGCTGCGTGTTCTCATGAAGGTAAATCCAGCTTCTACCGTAACC

TGCTGTGGCTGACCGAAAAAGAGGGTTCTTATCCTAAACTGAAAAACAGC

TACGTTAACAAAAAGGGCAAAGAAGTGCTGGTGCTGTGGGGTATCCATCA

CCCTCCGAACTCTAAAGAACAACAGAATCTGTATCAGAACGAAAACGCTT

ACGTTTCCGTGGTGACCTCTAACTATAACCGTCGTTTTACCCCGGAGATT

GCTGAACGTCCGAAAGTGCGCGATCAGGCTGGCCGTATGAACTACTATTG

GACCCTGCTGAAACCGGGCGATACCATCATTTTCGAAGCTAACGGCAACC

TGATTGCTCCGATGTATGCGTTTGCTCTGTCTCGTGGCTTCGGCTCTGGT

ATTATTACGTCTTAATAA

SEQ ID NO: 64 STF2.HA1-1 VN
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

-continued

CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACCACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTTTGC
AGCAGGCCGGTACTTCCGTTCTGGCGCAGGCTAACCAGGTCCCGCAGAAC
GTGCTGAGCCTGTTAGCGGAGAAGAAACACAATGGCAAACTGTGTGATCT
GGATGGTGTGAAACCGCTGATTCTGCGCGATTGCTCTGTGGCAGGCTGGC
TGCTGGGCAACCCTATGTGTGACGAATTCATTAACGTTCCGGAATGGTCT
TACATTGTTGAAAAAGCTAACCCTGTCAACGATCTGTGTTACCCTGGTGA
CTTTAACGATTACGAAGAACTGAAGCACCTGCTGTCTCGTATCAATCACT
TCGAGAAAATCCAGATCATCCCGAAATCCTCCTGGAGCTCCCACGAAGCT
TCTCTGGGCGTATCCTCCGCGTGCCCGTACCAGGGCAAATCCTCTTTCTT
TCGTAACGTTGTTTGGCTGATCAAGAAAAACTCCACCTACCCGACGATCA
AGCGTAGCTATAATAACACCAACCAGGAAGACCTGCTGGTTCTGTGGGGC
ATCCACCATCCAAACGATGCTGCGGAACAGACCAAGCTGTACCAGAACCC
GACCACCTACATCAGCGTGGGCACCTCTACGCTGAACCAGCGTCTGGTAC
CGCGTATCGCAACCCGCAGCAAGGTAAACGGTCAAAGCGGCCGCATGGAA
TTTTTCTGGACCATCCTGAAACCGAACGACGCAATCAACTTCGAATCTAA
CGGCAATTTCATCGCTCCGGAGTATGCGTACAAAATCGTAAAGAAAGGTG
ATAGCACTATCATGAAATCCGAGCTGGAATATGGCAACTGTAACACCAAA
TGCCAGACCCCGATGGGTGCAATCAACTCCTCCATGCCGTTTCACAACAT
TCACCCGCTGACTATCGGCGAATGTCCGAAATACGTTAAATAGTAA

SEQ ID NO: 65 FOR PRIMER
AGTGGCTGAGCCTGTTAGCGGAGAAGAAACACAATGGCAAACTGTG

SEQ ID NO: 66 REV PRIMER
AGTCGCTCAGCTTACTATTTAACGTATTTCGGACATTCGCCGATAGTCAG

SEQ ID NO: 67 HA0s VN
GTGCTGAGCCTGTTACGTCAGATTTGTATCGGCTACCACGCAAACAACTC
TACCGAGCAAGTTGATACCATCATGGAGAAAAACGTGACCGTTACTCACG
CGCAGGACATCCTGGAGAAGAAACACAATGGCAAACTGTGTGATCTGGAT
GGTGTGAAACCGCTGATTCTGCGCGATTGCTCTGTGGCAGGCTGGCTGCT
GGGCAACCCTATGTGTGACGAATTCATTAACGTTCCGGAATGGTCTTACA
TTGTTGAAAAAGCTAACCCTGTCAACGATCTGTGTTACCCTGGTGACTTT
AACGATTACGAAGAACTGAAGCACCTGCTGTCTCGTATCAATCACTTCGA
GAAAATCCAGATCATCCCGAAATCCTCCTGGAGCTCCCACGAAGCTTCTC
TGGGCGTATCCTCCGCGTGCCCGTACCAGGGCAAATCCTCTTTCTTTCGT
AACGTTGTTTGGCTGATCAAGAAAAACTCCACCTACCCGACGATCAAGCG
TAGCTATAATAACACCAACCAGGAAGACCTGCTGGTTCTGTGGGGCATCC
ACCATCCAAACGATGCTGCGGAACAGACCAAGCTGTACCAGAACCCGACC
ACCTACATCAGCGTGGGCACCTCTACGCTGAACCAGCGTCTGGTACCGCG
TATCGCAACCCGCAGCAAGGTAAACGGTCAAAGCGGCCGCATGGAATTTT
TCTGGACCATCCTGAAACCGAACGACGCAATCAACTTCGAATCTAACGGC
AATTTCATCGCTCCGGAGTATGCGTACAAAATCGTAAAGAAAGGTGATAG
CACTATCATGAAATCCGAGCTGGAATATGGCAACTGTAACACCAAATGCC
AGACCCCGATGGGTGCAATCAACTCCTCCATGCCGTTTCACAACATTCAC
CCGCTGACTATCGGCGAATGTCCGAAATACGTTAAATCCAATCGTCTGGT
TCTGGCTACCGGTCTGCGTAACTCCCCACAGCGTGAACGTCGTCGTAAGA
AACGTGGTCTGTTTGGCGCGATCGCTGGTTTCATCGAGGGCGGCTGGCAG
GGTATGGTTGATGGCTGGTACGGTTATCATCATTCCAATGAACAGGGTTC
CGGCTACGCCGCAGATAAAGAAAGCACTCAGAAAGCAATTGATGGCGTAA
CTAACAAAGTAAATTCTATCATTGATAAAATGAACACCCAGTTCGAGGCG
GTTGGTCGTGAGTTCAACAACCTGGAACGCCGTATCGAAAACCTGAACAA
GAAAATGGAAGACGGTTTTCTGGATGTGTGGACTTACAATGCTGAACTGC
TGGTGCTGATGGAAAACGAGCGTACCCTGGACTTCCACGACAGCAACGTC
AAAAATCTGTATGACAAAGTCCGTCTGCAGCTGCGTGATAACGCTAAAGA
GCTGGGTAATGGCTGCTTCGAGTTCTATCACAAATGCGACAACGAATGCA
TGGAATCTGTCCGCAACGGCACTTACGATTATCCGCAGTACTCCGAAGAA
GCGCGCCTGAAACGCGAAGAGATCTCCGGTGTGAAGCTGGAGTCTATTGG
CATCTACCAGATCCTGTCCATCTACAGCACCTAGTAAGCTGAGCGCCTAC
GCAGC

-continued

SEQ ID NO: 68 STF2.HA1-2 VN
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACCACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTTTGC
AGCAGGCCGGTACTTCCGTTCTGGCGCAGGCTAACCAGGTCCCGCAGAAC
GTGCTGAGCCTGTTAGCAGGTGTGAAACCGCTGATTCTGCGCGATTGCTC
TGTGGCAGGCTGGCTGCTGGGCAACCCTATGTGTGACGAATTCATTAACG
TTCCGGAATGGTCTTACATTGTTGAAAAAGCTAACCCTGTCAACGATCTG
TGTTACCCTGGTGACTTTAACGATTACGAAGAACTGAAGCACCTGCTGTC
TCGTATCAATCACTTCGAGAAAATCCAGATCATCCCGAAATCCTCCTGGA
GCTCCCACGAAGCTTCTCTGGGCGTATCCTCCGCGTGCCCGTACCAGGGC
AAATCCTCTTTCTTTCGTAACGTTGTTTGGCTGATCAAGAAAAACTCCAC
CTACCCGACGATCAAGCGTAGCTATAATAACACCAACCAGGAAGACCTGC
TGGTTCTGTGGGGCATCCACCATCCAAACGATGCTGCGGAACAGACCAAG
CTGTACCAGAACCCGACCACCTACATCAGCGTGGGCACCTCTACGCTGAA

-continued

CCAGCGTCTGGTACCGCGTATCGCAACCCGCAGCAAGGTAAACGGTCAAA
GCGGCCGCATGGAATTTTTCTGGACCATCCTGAAACCGAACGACGCAATC
AACTTCGAATCTAACGGCAATTTCATCGCTCCGGAGTATGCGTACAAAAT
CGTAAAGAAAGGTGATAGCACTATCATGAAATCCGAGTAGTAA

SEQ ID NO: 69 FOR PRIMER
AGTCGCTGAGCCTGTTAGCAGGTGTGAAACCGCTGATTCTGCGCGATTG

SEQ ID NO: 70 REV PRIMER
TGACGCTCAGCTTACTACTCGGATTTCATGATAGTGCTATCACCTTTC

SEQ ID NO: 71 STF2.HA1-2mut VN
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACCACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTTTGC
AGCAGGCCGGTACTTCCGTTCTGGCGCAGGCTAACCAGGTCCCGCAGAAC
GTGCTGAGCCTGTTAGCGGGTGCGAAACCGCTGTCTCTGCGCGATTGCTC
TGTGGCAGGCTGGCTGCTGGGCAACCCTATGTGTGACGAATTCATTAACG
TTCCGGAATGGTCTGATATTGCCGAAAAAGCTAACCCTGTCAACGATCTG -continued TGTTACCCTGGTGACTTTAACGATTACGAAGAACTGAAGCACCTGCTGTC
TCGTATCAATCACTTCGAGAAAATCCAGATCATCCCGAAATCCTCCTGGA
GCTCCCACGAAGCTTCTCTGGGCGTATCCTCCGCGTGCCCGTACCAGGGC
AAATCCTCTTTCTTTCGTAACGTTGTTTGGCTGATCAAGAAAAACTCCAC
CTACCCGACGATCAAGCGTAGCTATAATAACACCAACCAGGAAGACCTGC
TGGTTCTGTGGGGCATCCACCATCCAAACGATGCTGCGGAACAGACCAAG
CTGTACCAGAACCCGACCACCTACATCAGCGTGGGCACCTCTACGCTGAA
CCAGCGTCTGGTACCGCGTATCGCAACCCGCAGCAAGGTAAACGGTCAAA
GCGGCCGCATGGAATTTTTCTGGACCATCCTGAAACCGAACGACGCAATC
AACTTCGAATCTAACGGCAATTTCATCGCTCCGGAGTATGCGTACAAAAT
CGTAAAGAAAGGTGATAGCACTATCATGAAATCCGAGTAGTAA SEQ ID NO: 72 HA1-2mut VN
GGTGCGAAACCGCTGTCTCTGCGCGATTGCTCTGTGGCAGGCTGGCTGCT
GGGCAACCCTATGTGTGACGAATTCATTAACGTTCCGGAATGGTCTGATA
TTGCCGAAAAAGCTAACCCTGTCAACGATCTGTGTTACCCTGGTGACTTT
AACGATTACGAAGAACTGAAGCACCTGCTGTCTCGTATCAATCACTTCGA
GAAAATCCAGATCATCCCGAAATCCTCCTGGAGCTCCCACGAAGCTTCTC
TGGGCGTATCCTCCGCGTGCCCGTACCAGGGCAAATCCTCTTTCTTTCGT
AACGTTGTTTGGCTGATCAAGAAAAACTCCACCTACCCGACGATCAAGCG
TAGCTATAATAACACCAACCAGGAAGACCTGCTGGTTCTGTGGGGCATCC
ACCATCCAAACGATGCTGCGGAACAGACCAAGCTGTACCAGAACCCGACC
ACCTACATCAGCGTGGGCACCTCTACGCTGAACCAGCGTCTGGTACCGCG
TATCGCAACCCGCAGCAAGGTAAACGGTCAAAGCGGCCGCATGGAATTTT
TCTGGACCATCCTGAAACCGAACGACGCAATCAACTTCGAATCTAACGGC
AATTTCATCGCTCCGGAGTATGCGTACAAAATCGTAAAGAAAGGTGATAG
CACTATCATGAAATCCGAGTAGTAA SEQ ID NO: 73 STF2.HA1-1 IND
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT -continued GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACCACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTTTGC
AGCAGGCCGGTACTTCCGTTCTGGCGCAGGCTAACCAGGTCCCGCAGAAC
GTGCTGTCTCTGTTAGCGGAGAAAACGCATAACGGTAAACTGTGCGACCT
GGACGGCGTGAAGCCGCTGATCCTGCGTGACTGTTCTGTTGCTGGCTGGC
TGCTGGGCAACCCGATGTGCGATGAGTTCATCAACGTTCCGGAGTGGTCT
TATATTGTTGAAAAAGCGAACCCGACCAATGACCTGTGCTACCCGGGCTC
TTTTAATGACTACGAGGAGCTGAAACATCTGCTGTCTCGCATCAACCATT
TCGAAAAAATTCAGATCATCCCGAAATCTTCCTGGAGCGATCACGAAGCT
TCTTCCGGCGTATCTTCTGCATGCCCTTACCTGGGTTCCCCGTCTTTCTT
CCGTAACGTGGTTTGGCTGATCAAGAAGAACTCTACGTACCCGACCATCA
AGAAATCCTATAACAACACTAACCAGGAAGATCTGCTGGTGCTGTGGGGT
ATCCATCATCCAAACGATGCAGCCGAACAGACCCGCCTGTACCAGAATCC
GACCACGTACATCTCTATCGGCACTTCTACCCTGAATCAACGCCTGGTGC
CGAAAATCGCAACTCGCAGCAAAGTCAACGGCCAATCTGGTCGCATGGAG
TTTTTCTGGACCATCCTGAAACCGAACGACGCGATTAACTTCGAAAGCAA
CGGCAACTTCATTGCACCGGAATATGCTTACAAGATCGTTAAAAAGGGTG
ATTCTGCGATCATGAAAAGCGAGCTGGAATACGGCAACTGCAACACTAAA
TGCCAGACCCCGATGGGTGCAATCAATTCCAGCATGCCATTTCACAACAT
CCACCCGCTGACCATCGGCGAGTGTCCAAAATACGTTAAATAATAG

SEQ ID NO: 74 FOR PRIMER
AGTGGCTGAGCCTGTTAGCGGAGAAAACGCATAACGGTAAACTGTG

SEQ ID NO: 75 HA0s IND
GCTGAGCCTGTTACGTGATCAAATCTGCATCGGTTACCACGCAAACAACT
CCACTGAACAAGTGGATACGATCATGGAAAAGAACGTGACCGTGACCCAC
GCTCAAGATATCCTGGAGAAAACGCATAACGGTAAACTGTGCGACCTGGA
CGGCGTGAAGCCGCTGATCCTGCGTGACTGTTCTGTTGCTGGCTGGCTGC
TGGGCAACCCGATGTGCGATGAGTTCATCAACGTTCCGGAGTGGTCTTAT
ATTGTTGAAAAAGCGAACCCGACCAATGACCTGTGCTACCCGGGCTCTTT

-continued

TAATGACTACGAGGAGCTGAAACATCTGCTGTCTCGCATCAACCATTTCG

AAAAAATTCAGATCATCCCGAAATCTTCCTGGAGCGATCACGAAGCTTCT

TCCGGCGTATCTTCTGCATGCCCTTACCTGGGTTCCCCGTCTTTCTTCCG

TAACGTGGTTTGGCTGATCAAGAAGAACTCTACGTACCCGACCATCAAGA

AATCCTATAACAACACTAACCAGGAAGATCTGCTGGTGCTGTGGGGTATC

CATCATCCAAACGATGCAGCCGAACAGACCCGCCTGTACCAGAATCCGAC

CACGTACATCTCTATCGGCACTTCTACCCTGAATCAACGCCTGGTGCCGA

AAATCGCAACTCGCAGCAAAGTCAACGGCCAATCTGGTCGCATGGAGTTT

TTCTGGACCATCCTGAAACCGAACGACGCGATTAACTTCGAAAGCAACGG

CAACTTCATTGCACCGGAATATGCTTACAAGATCGTTAAAAAGGGTGATT

CTGCGATCATGAAAAGCGAGCTGGAATACGGCAACTGCAACACTAAATGC

CAGACCCCGATGGGTGCAATCAATTCCAGCATGCCATTTCACAACATCCA

CCCGCTGACCATCGGCGAGTGTCCAAAATACGTTAAATCCAATCGTCTGG

TGCTGGCAACGGGCCTGCGCAACTCTCCGCAACGTGAGTCTCGTCGCAAA

AAGCGTGGCCTGTTTGGCGCAATTGCGGGCTTCATCGAGGGCGGCTGGCA

GGGTATGGTTGATGGTTGGTACGGTTATCACCATTCCAACGAGCAGGGCT

CTGGTTACGCTGCGGACAAAGAGTCCACGCAGAAAGCGATCGATGGCGTC

ACCAACAAAGTGAACTCTATCATCGACAAGATGAACACTCAGTTCGAGGC

TGTGGGCCGTGAATTCAACAATCTGGAACGTCGCATCGAAAACCTGAACA

AAAAGATGGAAGACGGTTTCCTGGACGTATGGACCTATAACGCAGAGCTG

CTGGTTCTGATGGAAAACGAACGTACTCTGGACTTCCACGATTCTAACGT

TAAAAACCTGTACGACAAAGTTCGTCTGCAGCTGCGCGATAATGCAAAAG

AACTGGGTAACGGCTGCTTTGAATTTTACCACAAATGTGACAACGAATGC

ATGGAAAGCATCCGTAACGGTACCTACAATTACCCACAGTACTCCGAAGA

AGCGCGTCTGAAACGTGAAGAAATCTCCGGTGTAAAACTGGAATCCATTG

GCACGTATCAGATTCTGTCTATCTACTCCACGGTAGCGTCCTCTCTGGCG

CTGGCAATTATGATGGCCGGCCTGTCTCTGTGGATGTGCTCTAACGGCTC

TCTGCAGTGCCGCATCTGCATCTAATAGGCTGAGC

SEQ ID NO: 76 STF2.HA1-2 IND
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

-continued

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACCACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTTTGC

AGCAGGCCGGTACTTCCGTTCTGGCGCAGGCTAACCAGGTCCCGCAGAAC

GTGCTGAGCCTGTTAGCAGGTGTGAAACCGCTGATTCTGCGCGATTGTTC

TGTTGCTGGCTGGCTGCTGGGCAACCCGATGTGCGATGAGTTCATCAACG

TTCCGGAGTGGTCTTATATTGTTGAAAAAGCGAACCCGACCAATGACCTG

TGCTACCCGGGCTCTTTTAATGACTACGAGGAGCTGAAACATCTGCTGTC

TCGCATCAACCATTTCGAAAAAATTCAGATCATCCCGAAATCTTCCTGGA

GCGATCACGAAGCTTCTTCCGGCGTATCTTCTGCATGCCCTTACCTGGGT

TCCCCGTCTTTCTTCCGTAACGTGGTTTGGCTGATCAAGAAGAACTCTAC

GTACCCGACCATCAAGAAATCCTATAACAACACTAACCAGGAAGATCTGC

TGGTGCTGTGGGGTATCCATCATCCAAACGATGCAGCCGAACAGACCCGC

CTGTACCAGAATCCGACCACGTACATCTCTATCGGCACTTCTACCCTGAA

TCAACGCCTGGTGCCGAAAATCGCAACTCGCAGCAAAGTCAACGGCCAAT

CTGGTCGCATGGAGTTTTTCTGGACCATCCTGAAACCGAACGACGCGATT

AACTTCGAAAGCAACGGCAACTTCATTGCACCGGAATATGCTTACAAGAT

CGTTAAAAAGGGTGATTCTGCGATCATGAAAAGCGAGTAATAG

SEQ ID NO: 77 REV PRIMER
AGTCGCTCAGCCTATTACTCGCTTTTCATGATCGCAGAATCAC

SEQ ID NO: 78 STF2.HA1-2mut IND
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

-continued

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACCACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTTTGC

AGCAGGCCGGTACTTCCGTTCTGGCGCAGGCTAACCAGGTCCCGCAGAAC

GTGCTGTCTCTGTTAGCGGGCGCAAAGCCGCTGTCTCTGCGTGACTGTTC

TGTTGCTGGCTGGCTGCTGGGCAACCCGATGTGCGATGAGTTCATCAACG

TTCCGGAGTGGTCTGATATTGCGGAAAAAGCGAACCCGACCAATGACCTG

TGCTACCCGGGCTCTTTTAATGACTACGAGGAGCTGAAACATCTGCTGTC

TCGCATCAACCATTTCGAAAAAATTCAGATCATCCCGAAATCTTCCTGGA

GCGATCACGAAGCTTCTTCCGGCGTATCTTCTGCATGCCCTTACCTGGGT

TCCCCGTCTTTCTTCCGTAACGTGGTTTGGCTGATCAAGAAGAACTCTAC

GTACCCGACCATCAAGAAATCCTATAACAACACTAACCAGGAAGATCTGC

TGGTGCTGTGGGGTATCCATCATCCAAACGATGCAGCCGAACAGACCCGC

CTGTACCAGAATCCGACCACGTACATCTCTATCGGCACTTCTACCCTGAA

TCAACGCCTGGTGCCGAAAATCGCAACTCGCAGCAAAGTCAACGGCCAAT

CTGGTCGCATGGAGTTTTTCTGGACCATCCTGAAACCGAACGACGCGATT

AACTTCGAAAGCAACGGCAACTTCATTGCACCGGAATATGCTTACAAGAT

CGTTAAAAAGGGTGATTCTGCGATCATGAAAAGCGAGTAATAG

SEQ ID 79 HA1-2mut IND
GGCGCAAAGCCGCTGTCTCTGCGTGACTGTTCTGTTGCTGGCTGGCTGCT

GGGCAACCCGATGTGCGATGAGTTCATCAACGTTCCGGAGTGGTCTGATA

TTGCGGAAAAAGCGAACCCGACCAATGACCTGTGCTACCCGGGCTCTTTT

-continued

AATGACTACGAGGAGCTGAAACATCTGCTGTCTCGCATCAACCATTTCGA

AAAAATTCAGATCATCCCGAAATCTTCCTGGAGCGATCACGAAGCTTCTT

CCGGCGTATCTTCTGCATGCCCTTACCTGGGTTCCCCGTCTTTCTTCCGT

AACGTGGTTTGGCTGATCAAGAAGAACTCTACGTACCCGACCATCAAGAA

ATCCTATAACAACACTAACCAGGAAGATCTGCTGGTGCTGTGGGGTATCC

ATCATCCAAACGATGCAGCCGAACAGACCCGCCTGTACCAGAATCCGACC

ACGTACATCTCTATCGGCACTTCTACCCTGAATCAACGCCTGGTGCCGAA

AATCGCAACTCGCAGCAAAGTCAACGGCCAATCTGGTCGCATGGAGTTTT

TCTGGACCATCCTGAAACCGAACGACGCGATTAACTTCGAAAGCAACGGC

AACTTCATTGCACCGGAATATGCTTACAAGATCGTTAAAAAGGGTGATTC

TGCGATCATGAAAAGCGAGTAATAGGCTGAGC

SEQ ID NO: 80 STF2.HA1-1 NC
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACCACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTTTGC

AGCAGGCCGGTACTTCCGTTCTGGCGCAGGCTAACCAGGTCCCGCAGAAC

GTGCTGAGCCTGTTAGCGTCCCACAACGGTAAACTGTGTCTGCTGAAAGG

CATCGCACCGCTGCAGCTGGGTAACTGTAGCGTTGCAGGTTGGATCCTGG

GTAACCCGGAGTGCGAACTGCTGATTTCCAAGGAGAGCTGGTCTTACATT

GTCGAAACGCCGAATCCGGAAAACGGCACTTGTTATCCGGGTTACTTCGC

CGATTACGAAGAACTGCGTGAACAACTGTCTTCCGTGAGCTCTTTCGAAC

GTTTCGAGATCTTCCCGAAAGAGAGCAGCTGGCCAAACCACACTGTTACC

GGTGTGTCTGCGAGCTGTTCTCACAACGGCAAGTCTTCTTTCTACCGCAA

CCTGCTGTGGCTGACGGGTAAGAATGGCCTGTATCCGAACCTGTCTAAAT

CTTACGTAAACAACAAAGAGAAAGAGGTGCTGGTCCTGTGGGGCGTACAC

CATCCACCAAATATCGGCAACCAGCGCGCCCTGTACCACACCGAAAACGC

TTATGTGTCCGTGGTGAGCTCCCATTACAGCCGTCGTTTTACTCCGGAGA

TTGCCAAACGTCCGAAAGTTCGTGATCAGGAAGGCCGTATTAACTACTAC

TGGACTCTGCTGGAGCCGGGCGATACCATCATTTTCGAGGCAAACGGCAA

CCTGATTGCGCCATGGTACGCGTTCGCCCTGAGCCGTGGTTTTGGCTCCG

GTATTATCACCTCTAACGCGCCAATGGACGAATGCGACGCGAAATGCCAA

ACGCCGCAGGGCGCAATCAACAGCAGCCTGCCGTTCCAGAACGTTCACCC

GGTTACCATCGGCGAATGCCCTAAATACGTGCGCTAATAG

SEQ ID NO: 81 FOR PRIMER
AACCAGGTCCCGCAGAACGTGCTGAGCCTGTTAGCGTCCCACAACGGTAA

ACTGTGTCTGCTGAAAGGCATCGCACCGCTGCAG

SEQ ID NO: 82 REV PRIMER
GAACAGCTCAGTTCCTACGAGCTCAGCCTATTAGCGCACGTATTTAGGGC

ATTCGCCGATGGTAACCGGGTGAACGTT

SEQ ID NO: 83 HA0s NC
GACACGATCTGTATTGGTTATCATGCAAACAACTCTACTGACACTGTAGA

TACTGTGCTGGAAAAGAACGTAACCGTTACCCACAGCGTTAACCTGCTGG

AAGATTCCCACAACGGTAAACTGTGTCTGCTGAAAGGCATCGCACCGCTG

CAGCTGGGTAACTGTAGCGTTGCAGGTTGGATCCTGGGTAACCCGGAGTG

CGAACTGCTGATTTCCAAGGAGAGCTGGTCTTACATTGTCGAAACGCCGA

ATCCGGAAAACGGCACTTGTTATCCGGGTTACTTCGCCGATTACGAAGAA

CTGCGTGAACAACTGTCTTCCGTGAGCTCTTTCGAACGTTTCGAGATCTT

CCCGAAAGAGAGCAGCTGGCCAAACCACACTGTTACCGGTGTGTCTGCGA

GCTGTTCTCACAACGGCAAGTCTTCTTTCTACCGCAACCTGCTGTGGCTG

ACGGGTAAGAATGGCCTGTATCCGAACCTGTCTAAATCTTACGTAAACAA

CAAAGAGAAAGAGGTGCTGGTCCTGTGGGGCGTACACCATCCACCAAATA

TCGGCAACCAGCGCGCCCTGTACCACACCGAAAACGCTTATGTGTCCGTG

GTGAGCTCCCATTACAGCCGTCGTTTTACTCCGGAGATTGCCAAACGTCC

GAAAGTTCGTGATCAGGAAGGCCGTATTAACTACTACTGGACTCTGCTGG

AGCCGGGCGATACCATCATTTTCGAGGCAAACGGCAACCTGATTGCGCCA

TGGTACGCGTTCGCCCTGAGCCGTGGTTTTGGCTCCGGTATTATCACCTC

TAACGCGCCAATGGACGAATGCGACGCGAAATGCCAAACGCCGCAGGGCG

CAATCAACAGCAGCCTGCCGTTCCAGAACGTTCACCCGGTTACCATCGGC

GAATGCCCTAAATACGTGCGCTCCGCCAAACTGCGCATGGTTACTGGTCT

GCGTAACATCCCGAGCATTCAGTCTCGCGGTCTGTTCGGTGCGATCGCGG

GCTTCATTGAAGGCGGTTGGACCGGTATGGTGGATGGTTGGTACGGCTAC

CATCACCAGAACGAACAGGGTAGCGGTTACGCTGCCGACCAGAAATCCAC

CCAGAACGCTATTAACGGTATCACCAACAAAGTTAACAGCGTAATTGAGA

AGATGAACACGCAGTTCACCGCCGTAGGTAAGGAATTCAACAAGCTGGAA

CGTCGCATGGAAAACCTGAACAAAAAGGTGGACGACGGCTTTCTGGACAT

CTGGACCTACAACGCTGAACTGCTGGTGCTGCTGGAAAACGAACGTACCC

TGGATTTCCACGACTCTAATGTTAAAAACCTGTACGAAAAGGTCAAGTCT

CAACTGAAAAACAATGCGAAGGAAATCGGCAACGGCTGTTTCGAATTCTA

CCATAAATGCAACAACGAATGCATGGAATCCGTTAAAAACGGTACCTATG

ACTACCCTAAATACTCCGAAGAAAGCAAACTGAACCGCGAGAAAATCGAT

GGTGTAAAACTGGAATCTATGGGTGTTTACCAGATCCTGGCGATCTACTC

CACGGTAGCCAGCAGCCTGGTTCTGCTGGTTAGCCTGGGTGCAATTAGCT

TCTGGATGTGCTCTAACGGCAGCCTGCAATGCCGCATCTGTAATAGGCTG

AGC

SEQ ID NO: 84 STF2HA1-2 NC
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACCACAAGTTATACTGCTGCTGACGGCAC

TACCAAAACAGCGGCTAACCAACTGGGTGGCGTAGACGGTAAAACCGAAG

-continued

TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTTTGC
AGCAGGCCGGTACTTCCGTTCTGGCGCAGGCTAACCAGGTCCCGCAGAAC
GTGCTGAGCCTGTTAGCGAAAGGCATCGCACCGCTGCAGCTGGGTAACTG
TAGCGTTGCAGGTTGGATCCTGGGTAACCCGGAGTGCGAACTGCTGATTT
CCAAGGAGAGCTGGTCTTACATTGTCGAAACGCCGAATCCGGAAAACGGC
ACTTGTTATCCGGGTTACTTCGCCGATTACGAAGAACTGCGTGAACAACT
GTCTTCCGTGAGCTCTTTCGAACGTTTCGAGATCTTCCCGAAAGAGAGCA
GCTGGCCAAACCACACTGTTACCGGTGTGTCTGCGAGCTGTTCTCACAAC
GGCAAGTCTTCTTTCTACCGCAACCTGCTGTGGCTGACGGGTAAGAATGG
CCTGTATCCGAACCTGTCTAAATCTTACGTAAACAACAAAGAGAAAGAGG
TGCTGGTCCTGTGGGGCGTACACCATCCACCAAATATCGGCAACCAGCGC
GCCCTGTACCACACCGAAAACGCTTATGTGTCCGTGGTGAGCTCCCATTA
CAGCCGTCGTTTTACTCCGGAGATTGCCAAACGTCCGAAAGTTCGTGATC
AGGAAGGCCGTATTAACTACTACTGGACTCTGCTGGAGCCGGGCGATACC
ATCATTTTCGAGGCAAACGGCAACCTGATTGCGCCATGGTACGCGTTCGC
CCTGAGCCGTGGTTTTGGCTCCGGTATTATCACCTCTTAATAA

SEQ ID NO: 85 FOR PRIMER
AACCAGGTCCCGCAGAACGTGCTGAGCCTGTTAGCGAAAGGCATCGCACC
GCTGCAGCTGGGTAACTGTAGCGTTGCAGGTTGG

SEQ ID NO: 86 REV PRIMER
GAACAGCTCAGTTCCTACGAGCTCAGCCTATTAAGAGGTGATAATACCGG
AGCCAAAACCACGGCTCAGGGCGAACGCGTACCA

SEQ ID NO: 87 STF2.HA1-2mut NC
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACCACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTTTGC
AGCAGGCCGGTACTTCCGTTCTGGCGCAGGCTAACCAGGTCCCGCAGAAC
GTGCTGAGCCTGTTAGCGAAAGGCGCGGCACCGCTGCAGCTGGGTAACTG
TAGCGTTGCAGGTTGGATCCTGGGTAACCCGGAGTGCGAACTGCTGATTT
CCAAGGAGAGCTGGTCTGATATTGCAGAAACGCCGAATCCGGAAAACGGC
ACTTGTTATCCGGGTTACTTCGCCGATTACGAAGAACTGCGTGAACAACT
GTCTTCCGTGAGCTCTTTCGAACGTTTCGAGATCTTCCCGAAAGAGAGCA
GCTGGCCAAACCACACTGTTACCGGTGTGTCTGCGAGCTGTTCTCACAAC
GGCAAGTCTTCTTTCTACCGCAACCTGCTGTGGCTGACGGGTAAGAATGG
CCTGTATCCGAACCTGTCTAAATCTTACGTAAACAACAAAGAGAAAGAGG
TGCTGGTCCTGTGGGGCGTACACCATCCACCAAATATCGGCAACCAGCGC
GCCCTGTACCACACCGAAAACGCTTATGTGTCCGTGGTGAGCTCCCATTA
CAGCCGTCGTTTTACTCCGGAGATTGCCAAACGTCCGAAAGTTCGTGATC
AGGAAGGCCGTATTAACTACTACTGGACTCTGCTGGAGCCGGGCGATACC
ATCATTTTCGAGGCAAACGGCAACCTGATTGCGCCATGGTACGCGTTCGC
CCTGAGCCGTGGTTTTGGCTCCGGTATTATCACCTCTTAATAG SEQ ID NO: 88 HA1-2mut NC
GCTGAGCCTGTTAGCGAAAGGCGCGGCACCGCTGCAGCTGGGTAACTGTA
GCGTTGCAGGTTGGATCCTGGGTAACCCGGAGTGCGAACTGCTGATTTCC
AAGGAGAGCTGGTCTGATATTGCAGAAACGCCGAATCCGGAAAACGGCAC
TTGTTATCCGGGTTACTTCGCCGATTACGAAGAACTGCGTGAACAACTGT
CTTCCGTGAGCTCTTTCGAACGTTTCGAGATCTTCCCGAAAGAGAGCAGC
TGGCCAAACCACACTGTTACCGGTGTGTCTGCGAGCTGTTCTCACAACGG
CAAGTCTTCTTTCTACCGCAACCTGCTGTGGCTGACGGGTAAGAATGGCC
TGTATCCGAACCTGTCTAAATCTTACGTAAACAACAAAGAGAAAGAGGTG
CTGGTCCTGTGGGGCGTACACCATCCACCAAATATCGGCAACCAGCGCGC
CCTGTACCACACCGAAAACGCTTATGTGTCCGTGGTGAGCTCCCATTACA GCCGTCGTTTTACTCCGGAGATTGCCAAACGTCCGAAAGTTCGTGATCAG
GAAGGCCGTATTAACTACTACTGGACTCTGCTGGAGCCGGGCGATACCAT
CATTTTCGAGGCAAACGGCAACCTGATTGCGCCATGGTACGCGTTCGCCC
TGAGCCGTGGTTTTGGCTCCGGTATTATCACCTCTTAATAGGCTGAGC SEQ ID NO: 89 STF2.HA1-1his (PR8)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLASHNGKLCRLKGIAPLQLGKCNIAGWLLGNPECDPLLPVRSWSYI
VETPNSENGICYPGDFIDYEELREQLSSVSSFERFEIFPKESSWPNHNTN
GVTAACSHEGKSSFYRNLLWLTEKEGSYPKLKNSYVNKKGKEVLVLWGIH
HPPNSKEQQNLYQNENAYVSVVTSNYNRRFTPEIAERPKVRDQAGRMNYY
WTLLKPGDTIIFEANGNLIAPMYAFALSRGFGSGIITSNASMHECNTKCQ
TPLGAINSSLPYQNIHPVTIGECPKYVRHHHHHH SEQ ID NO: 90 STF2.HA1-2 (PR8)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLAKGIAPLQLGKCNIAGWLLGNPECDPLLPVRSWSYIVETPNSENG
ICYPGDFIDYEELREQLSSVSSFERFEIFPKESSWPNHNTNGVTAACSHE
GKSSFYRNLLWLTEKEGSYPKLKNSYVNKKGKEVLVLWGIHHPPNSKEQQ
NLYQNENAYVSVVTSNYNRRFTPEIAERPKVRDQAGRMNYYWTLLKPGDT
IIFEANGNLIAPMYAFALSRGFGSGIITS SEQ ID NO: 91 STF2.HA1-2mut (PR8)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLAKGAAPLQLGKCNIAGWLLGNPECDPLLPVRSWSDIAETPNSENG
ICYPGDFIDYEELREQLSSVSSFERFEIFPKESSWPNHNTNGVTAACSHE
GKSSFYRNLLWLTEKEGSYPKLKNSYVNKKGKEVLVLWGIHHPPNSKEQQ
NLYQNENAYVSVVTSNYNRRFTPEIAERPKVRDQAGRMNYYWTLLKPGDT
IIFEANGNLIAPMYAFALSRGFGSGIITS SEQ ID NO: 92 STF2.HA1-3 (PR8)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLANSENGICYPGDFIDYEELREQLSSVSSFERFEIFPKESSWPNHN
TNGVTAACSHEGKSSFYRNLLWLTEKEGSYPKLKNSYVNKKGKEVLVLWG
IHHPPNSKEQQNLYQNENAYVSVVTSNYNRRFTPEIAERPKVRDQAGRMN
YYWTLLKPGDTIIFEANGNLIAPMYAFALSRG SEQ ID NO: 93 HA1-2his (PR8)
KGIAPLQLGKCNIAGWLLGNPECDPLLPVRSWSYIVETPNSENGICYPGD
FIDYEELREQLSSVSSFERFEIFPKESSWPNHNTNGVTAACSHEGKSSFY
RNLLWLTEKEGSYPKLKNSYVNKKGKEVLVLWGIHHPPNSKEQQNLYQNE
NAYVSVVTSNYNRRFTPEIAERPKVRDQAGRMNYYWTLLKPGDTIIFEAN
GNLIAPMYAFALSRGFGSGIITSHHHHHH SEQ ID NO: 94 STF2.4xM2e
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN -continued LGNTVNNLSEARSRIEDSDYATEVSNMSRAQILQQAGTSVLAQANQVPQN
VLSLLRLSLLTEVETPIRNEWGSRSNDSSDPLESLLTEVETPIRNEWGSR
SNDSSDPGSSLLTEVETPIRNEWGSRSNDSSDPELSLLTEVETPIRNEWG
SRSNDSSDPSR SEQ ID NO: 95 STF2.HA1-2 (VN)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLAGVKPLILRDCSVAGWLLGNPMCDEFINVPEWSYIVEKANPVNDL
CYPGDFNDYEELKHLLSRINHFEKIQIIPKSSWSSHEASLGVSSACPYQG
KSSFFRNVVWLIKKNSTYPTIKRSYNNTNQEDLLVLWGIHHPNDAAEQTK
LYQNPTTYISVGTSTLNQRLVPRIATRSKVNGQSGRMEFFWTILKPNDAI
NFESNGNFIAPEYAYKIVKKGDSTIMKSE SEQ ID NO: 96 STF2
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLA SEQ ID NO: 97 STF2.Blp.wt
ATGAAATTCTTAGTCAACGTTGCCCTTGTTTTTATGGTCGTATACATTTC
TTACATCTATGCGGCCCAGGTTATCAATACCAACTCCCTGTCGTTGCTCA
CCCAAAATAACCTTAATAAAAGCCAGAGCGCACTGGGAACCGCCATAGAA
CGCCTCTCAAGCGGCCTCCGGATCAATTCTGCAAAAGACGACGCCGCCGG
TCAGGCCATCGCAAACCGCTTTACCGCCAATATCAAGGGACTGACGCAGG
CTTCGAGGAATGCTAACGATGGAATAAGCATCGCTCAAACCACGGAGGGC
GCCCTGAACGAGATCAACAACAACCTACAGCGCGTCAGGGAGCTCGCAGT
GCAGTCCGCCAATTCGACCAACTCGCAGTCGGACCTGGACTCGATCCAAG
CCGAAATCACCCAGCGCCTGAATGAGATTGACCGGGTGAGCGGTCAGACA
CAGTTTAACGGCGTGAAGGTACTTGCACAGGATAACACACTTACGATACA
GGTGGGCGCCAACGATGGTGAAACCATAGACATTGATCTCAAACAGATTA
ACAGCCAGACGCTCGGGTTGGATAGCCTGAATGTGCAAAAGGCGTACGAC
GTGAAAGACACGGCGGTCACTACCAAAGCCTACGCTAACAATGGCACTAC
CTTGGATGTGAGCGGATTGGATGATGCAGCAATCAAGGCTGCTACCGGCG
GTACGAACGGAACCGCGTCCGTGACCGGCGGTGCCGTGAAGTTCGATGCT
GACAACAATAAGTATTTCGTCACCATTGGAGGCTTTACTGGCGCCGACGC
AGCAAAGAACGGCGACTATGAAGTGAACGTGGCAACCGATGGAACCGTGA
CGCTGGCCGCTGGTGCCACCAAGACCACCATGCCAGCCGGCGCCACAACT
AAGACCGAGGTGCAGGAGTTAAAGGACACCCCCGCGGTGGTTAGCGCAGA
TGCCAAAAACGCGTTGATCGCCGGCGGAGTGGATGCAACTGATGCTAATG
GTGCGGAGCTGGTTAAAATGTCGTATACAGACAAGAATGGTAAGACGATC
GAGGGCGGTTATGCCCTTAAGGCAGGAGATAAGTATTACGCTGCTGATTA
CGATGAGGCGACGGGAGCTATTAAGGCCAAGACAACGTCATACACGGCGG
CGGACGGAACGACTAAGACGGCTGCCAATCAGTTGGGAGGGGTTGACGGG
AAGACAGAGGTCGTTACGATCGATGGCAAGACATACAACGCCTCCAAGGC
CGCTGGCCACGATTTCAAAGCTCAACCCGAACTGGCCGAGGCCGCGGCGA
AAACAACTGAGAACCCGTTGCAGAAGATTGATGCGGCCCTGGCGCAAGTA
GATGCCCTGCGCTCAGACCTGGGCGCCGTTCAAAATCGATTCAATTCCGC
GATTACAAACCTGGGCAATACAGTAAACAATCTATCCGAGGCCAGATCCC
GCATTGAAGACTCCGACTACGCGACAGAAGTAAGTAACATGAGTCGTGCC
CAGATTCTGCAGCAGGCCGGCACTAGTGTCCTGGCCCAGGCCAATCAAGT
CCCGCAGAATGTGCTGAGCCTACTACGAGAGTTCAGTCGTTACCCAGCCC
AATGGCGGCCGCTC SEQ ID NO: 98 STF2.Blp.ng
ATGAAATTCTTAGTCAACGTTGCCCTTGTTTTTATGGTCGTATACATTTC
TTACATCTATGCGGCCCAAGTGATCAACACCAACTCCCTGTCCCTGCTCA
CTCAAAACAACCTCCAGAAATCTCAGTCTGCTCTCGGTACTGCTATCGAG
CGTCTCTCCTCCGGCCTGAGGATCAACTCCGCTAAAGATGACGCCGCCGG
ACAAGCTATCGCTAACCGCTTTACTGCCAACATTAAAGGCCTGACCCAAG
CCTCTAGGAACGCCAATGATGGCATTTCTATCGCTCAAACCACCGAAGGC
GCCCTGAACGAAATCAATAATAACCTGCAACGTGTCCGCGAACTCGCCGT
CCAGTCCGCCCAATCTACCAACTCTCAGTCTGACCTGGACTCTATCCAAG
CTGAGATCACCCAAAGGCTCAACGAGATCGATCGTGTGTCTGGTCAAACT
CAGTTTAACGGCGTCAAAGTGCTGGCTCAAGACAACACACTCACCATCCA
AGTAGGAGCCAATGACGGCGAGACAATCGATATCGACCTGAAGCAGATCA
ATTCTCAAACTCTGGGCCTGGACTCCCTGAACGTCCAAAAGGCTTACGAC
GTGAAGGACACCGCTGTGACAACCAAAGCCTATGCTAATCAAGGAACAAC
CCTGGACGTGTCCGGACTCGATGACGCCGCTATCAAGGCCGCTACTGGCG
GCACTCAGGGAACTGCCTCTGTGACCGGAGGCGCTGTGAAGTTCGACGCC
GATAACAACAAATACTTCGTCACTATTGGTGGTTTCACTGGCGCTGACGC -continued

CGCTAAGAACGGTGACTACGAGGTCAACGTCGCCACTGACGGAACAGTGA

CACTGGCCGCTGGCGCTACCAAGACCACAATGCCTGCTGGTGCTACTACT

AAGACAGAGGTGCAGGAACTCAAGGACACCCCTGCCGTGGTGTCCGCCGA

TGCTAAGAACGCTCTCATTGCTGGTGGTGTCGACGCTACGGACGCCAACG

GAGCCGAGCTTGTGAAAATGTCCTACACCGACAAGAACGGAAAGACTATC

GAGGGAGGTTACGCTCTGAAGGCTGGCGATAAGTACTACGCCGCTGATTA

TGACGAAGCTACAGGCGCCATTAAAGCTAAAACCACATCTTATACCGCTG

CCGATGGTACTACCAAGACTGCTGCCAATCAGCTGGGTGGAGTCGATGGA

AAAACCGAAGTGGTCACAATCGACGGAAAGACCTATCAAGCCTCCAAGGC

TGCTGGCCACGACTTCAAGGCCCAACCCGAACTGGCCGAGGCTGCTGCTA

AAACCACTGAAAACCCCCTGCAGAAAATTGACGCTGCCCTGGCCCAAGTG

GATGCCCTCCGCTCCGACCTCGGCGCTGTGCAAAACCGCTTCAACTCCGC

TATTACAAACCTCGGCAATACCGTCAATCAGCTCTCTGAAGCTAGGTCTC

GTATTGAGGATTCCGATTACGCTACCGAGGTCTCCCAGATGTCCCGTGCC

CAAATTCTCCAACAAGCCGGCACCTCCGTCCTCGCCCAAGCCAATCAGGT

GCCACAGAATGTGCTGAGC

SEQ ID NO: 99 Honey Bee mellitin
ATGAAATTCTTAGTCAACGTTGCCCTTGTTTTTATGGTCGTATACATTTC

TTACATCTATGCG

SEQ ID NO: 100 STF2.HA0s
ATGAAATTCTTAGTCAACGTTGCCCTTGTTTTTATGGTCGTATACATTTC

TTACATCTATGCGGCCCAGGTTATCAATACCAACTCCCTGTCGTTGCTCA

CCCAAAATAACCTTAATAAAAGCCAGAGCGCACTGGGAACCGCCATAGAA

CGCCTCTCAAGCGGCCTCCGGATCAATTCTGCAAAAGACGACGCCGCCGG

TCAGGCCATCGCAAACCGCTTTACCGCCAATATCAAGGGACTGACGCAGG

CTTCGAGGAATGCTAACGATGGAATAAGCATCGCTCAAACCACGGAGGGC

GCCCTGAACGAGATCAACAACAACCTACAGCGCGTCAGGGAGCTCGCAGT

GCAGTCCGCCAATTCGACCAACTCGCAGTCGGACCTGGACTCGATCCAAG

CCGAAATCACCCAGCGCCTGAATGAGATTGACCGGGTGAGCGGTCAGACA

CAGTTTAACGGCGTGAAGGTACTTGCACAGGATAACACACTTACGATACA

GGTGGGCGCCAACGATGGTGAAACCATAGACATTGATCTCAAACAGATTA

ACAGCCAGACGCTCGGGTTGGATAGCCTGAATGTGCAAAAGGCGTACGAC

GTGAAAGACACGGCGGTCACTACCAAAGCCTACGCTAACAATGGCACTAC

CTTGGATGTGAGCGGATTGGATGATGCAGCAATCAAGGCTGCTACCGGCG

GTACGAACGGAACCGCGTCCGTGACCGGCGGTGCCGTGAAGTTCGATGCT

GACAACAATAAGTATTTCGTCACCATTGGAGGCTTTACTGGCGCCGACGC

AGCAAAGAACGGCGACTATGAAGTGAACGTGGCAACCGATGGAACCGTGA

CGCTGGCCGCTGGTGCCACCAAGACCACCATGCCAGCCGGCGCCACAACT

AAGACCGAGGTGCAGGAGTTAAAGGACACCCCCGCGGTGGTTAGCGCAGA

TGCCAAAAACGCCTTGATCGCCGGCGGAGTGGATGCAACTGATGCTAATG

GTGCGGAGCTGGTTAAAATGTCGTATACAGACAAGAATGGTAAGACGATC

-continued

GAGGGCGGTTATGCCCTTAAGGCAGGAGATAAGTATTACGCTGCTGATTA

CGATGAGGCGACGGGAGCTATTAAGGCCAAGACAACGTCATACACGGCGG

CGGACGGAACGACTAAGACGGCTGCCAATCAGTTGGGAGGGGTTGACGGG

AAGACAGAGGTCGTTACGATCGATGGCAAGACATACAACGCTTCCAAGGC

CGCTGGCCACGATTTCAAAGCTCAACCCGAACTGGCCGAGGCCGCGGCGA

AAACAACTGAGAACCCGTTGCAGAAGATTGATGCGGCCCTGGCGCAAGTA

GATGCCCTGCGCTCAGACCTGGGCGCCGTTCAAAATCGATTCAATTCCGC

GATTACAAACCTGGGCAATACAGTAAACAATCTATCCGAGGCCAGATCCC

GCATTGAAGACTCCGACTACGCGACAGAAGTAAGTAACATGAGTCGTGCC

CAGATTCTGCAGCAGGCCGGCACTAGTGTCCTGGCCCAGGCCAATCAAGT

CCCGCAGAATGTGCTGAGCCTACTAGCATCAGGTTCCGGCTCAGGTTCCG

ACACCATTTGCATTGGATACCATGCAAACAACTCAACCGATACTGTTGAT

ACCGTCCTTGAGAAGAACGTTACCGTCACGCACTCGGTCAACCTATTAGA

GGATAGCCACAACGGAAAGCTGTGCCGTCTGAAAGGCATAGCGCCACTGC

AGCTCGGCAAATGTAACATCGCAGGTTGGCTCCTTGGTAACCCGGAGTGC

GACCCCCTCCTCCCTGTACGATCCTGGAGTTATATCGTGGAGACCCCCAA

TAGCGAGAACGGAATTTGCTACCCAGGAGATTTCATAGACTACGAGGAGT

TGCGCGAGCAGCTTTCGTCTGTGAGCAGCTTCGAAAGGTTCGAGATATTC

CCGAAGGAGAGCAGCTGGCCGAATCATAACACTAACGGTGTGACAGCCGC

CTGCAGTCATGAAGGAAAGAGTTCATTCTATCGCAACCTGCTGTGGTTGA

CGGAGAAAGAGGGCAGCTACCCTAAGTTGAAGAACTCCTATGTGAACAAA

AAAGGCAAGGAGGTTCTGGTGCTGTGGGGCATACACCACCCCCCCAATAG

CAAGGAGCAGCAGAATCTGTACCAAAACGAGAATGCCTATGTGAGCGTGG

TCACTAGTAACTATAACCGTCGGTTCACTCCCGAGATCGCCGAGCGTCCG

AAGGTGAGGGACCAGGCAGGCCGGATGAACTACTACTGGACCCTATTGAA

GCCAGGGGACACGATTATCTTCGAGGCAAACGGAAACCTCATAGCGCCGA

TGTACGCCTTCGCCCTGAGCCGTGGCTTTGGATCGGGGATCATCACGTCT

AACGCCTCGATGCACGAATGTAATACCAAATGCCAGACCCCACTGGGTGC

TATCAACTCGTCCTTACCCTATCAAAATATACATCCGGTCACCATAGGCG

AGTGTCCCAAATATGTCAGATCCGCCAAGTTGCGGATGGTGACCGGCCTC

CGCAATATTCCTAGTATTCAGTCACGCGGCTTGTTCGGCGCCATCGCTGG

TTTCATCGAAGGCGGGTGGACAGGCATGATTGATGGCTGGTATGGCTATC

ACCACCAGAACGAGCAGGGCTCGGGCTACGCGGCTGACCAGAAGTCGACT

CAGAATGCCATCAATGGCATCACGAATAAGGTGAACACGGTCATTGAAAA

GATGAACATTCAATTTACAGCCGTAGGAAAAGAGTTTAATAAACTGGAAA

AAAGAATGGAGAATCTGAATAAGAAGGTGGACGACGGATTTTTGGACATC

TGGACGTACAACGCCGAGCTGCTGGTTCTGCTGGAAAATGAGCGAACACT

GGATTTTCATGATTCTAACGTAAAGAATCTGTACGAGAAGGTGAAGTCCC

AACTAAAGAATAATGCCAAGGAAATCGGAAATGGATGCTTTGAGTTTTAC

CACAAGTGCGATAATGAGTGCATGGAATCCGTGCGAAATGGTACATACGA

TTACCCAAAGTACTCCGAAGAATCCAAGCTAAATCGCGAAAAGGTTGATG

GTGTTAAACTTGAATCCATGGGTATTTACCAACACCATCATCACCACCAT

TAATAG

SEQ ID NO: 101 FOR PRIMER
AGTCGCTGAGCCTACTAGCATCAGGTTCCGGCTCAGGTTCCGACACCATT

TGCATTGGATACCATGC

SEQ ID NO: 102 REV PRIMER
AGTCGCATGCCTATTAATGGTGGTGATGATGGTGTTGGTAAATACCCATG

GATTC

SEQ ID NO: 103 HA0s PR8
GACACCATTTGCATTGGATACCATGCAAACAACTCAACCGATACTGTTGA

TACCGTCCTTGAGAAGAACGTTACCGTCACGCACTCGGTCAACCTATTAG

AGGATAGCCACAACGGAAAGCTGTGCCGTCTGAAAGGCATAGCGCCACTG

CAGCTCGGCAAATGTAACATCGCAGGTTGGCTCCTTGGTAACCCGGAGTG

CGACCCCCTCCTCCCTGTACGATCCTGGAGTTATATCGTGGAGACCCCCA

ATAGCGAGAACGGAATTTGCTACCCAGGAGATTTCATAGACTACGAGGAG

TTGCGCGAGCAGCTTTCGTCTGTGAGCAGCTTCGAAAGGTTCGAGATATT

CCCGAAGGAGAGCAGCTGGCCGAATCATAACACTAACGGTGTGACAGCCG

CCTGCAGTCATGAAGGAAAGAGTTCATTCTATCGCAACCTGCTGTGGTTG

ACGGAGAAAGAGGGCAGCTACCCTAAGTTGAAGAACTCCTATGTGAACAA

AAAAGGCAAGGAGGTTCTGGTGCTGTGGGGCATACACCACCCCCCCAATA

GCAAGGAGCAGCAGAATCTGTACCAAAACGAGAATGCCTATGTGAGCGTG

GTCACTAGTAACTATAACCGTCGGTTCACTCCCGAGATCGCCGAGCGTCC

GAAGGTGAGGGACCAGGCAGGCCGGATGAACTACTACTGGACCCTATTGA

AGCCAGGGGACACGATTATCTTCGAGGCAAACGGAAACCTCATAGCGCCG

ATGTACGCCTTCGCCCTGAGCCGTGGCTTTGGATCGGGGATCATCACGTC

TAACGCCTCGATGCACGAATGTAATACCAAATGCCAGACCCCACTGGGTG

CTATCAACTCGTCCTTACCCTATCAAAATATACATCCGGTCACCATAGGC

GAGTGTCCCAAATATGTCAGATCCGCCAAGTTGCGGATGGTGACCGGCCT

CCGCAATATTCCTAGTATTCAGTCACGCGGCTTGTTCGGCGCCATCGCTG

GTTTCATCGAAGGCGGGTGGACAGGCATGATTGATGGCTGGTATGGCTAT

CACCACCAGAACGAGCAGGGCTCGGGCTACGCGGCTGACCAGAAGTCGAC

TCAGAATGCCATCAATGGCATCACGAATAAGGTGAACACGGTCATTGAAA

AGATGAACATTCAATTTACAGCCGTAGGAAAAGAGTTTAATAAACTGGAA

AAAAGAATGGAGAATCTGAATAAGAAGGTGGACGACGGATTTTTGGACAT

CTGGACGTACAACGCCGAGCTGCTGGTTCTGCTGGAAAATGAGCGAACAC

TGGATTTTCATGATTCTAACGTAAAGAATCTGTACGAGAAGGTGAAGTCC

CAACTAAAGAATAATGCCAAGGAAATCGGAAATGGATGCTTTGAGTTTTA

CCACAAGTGCGATAATGAGTGCATGGAATCCGTGCGAAATGGTACATACG

ATTACCCAAAGTACTCCGAAGAATCCAAGCTAAATCGCGAAAAGGTTGAT

GGTGTTAAACTTGAATCCATGGGTATTTACCAACACCATCATCACCACCA

TTAATAG

-continued

SEQ ID NO: 104 STF2.HA1-1
ATGAAATTCTTAGTCAACGTTGCCCTTGTTTTTATGGTCGTATACATTTC

TTACATCTATGCGGCCCAGGTTATCAATACCAACTCCCTGTCGTTGCTCA

CCCAAAATAACCTTAATAAAAGCCAGAGCGCACTGGGAACCGCCATAGAA

CGCCTCTCAAGCGGCCTCCGGATCAATTCTGCAAAAGACGACGCCGCCGG

TCAGGCCATCGCAAACCGCTTTACCGCCAATATCAAGGGACTGACGCAGG

CTTCGAGGAATGCTAACGATGGAATAAGCATCGCTCAAACCACGGAGGGC

GCCCTGAACGAGATCAACAACAACCTACAGCGCGTCAGGGAGCTCGCAGT

GCAGTCCGCCAATTCGACCAACTCGCAGTCGGACCTGGACTCGATCCAAG

CCGAAATCACCCAGCGCCTGAATGAGATTGACCGGGTGAGCGGTCAGACA

CAGTTTAACGGCGTGAAGGTACTTGCACAGGATAACACACTTACGATACA

GGTGGGCGCCAACGATGGTGAAACCATAGACATTGATCTCAAACAGATTA

ACAGCCAGACGCTCGGGTTGGATAGCCTGAATGTGCAAAAGGCGTACGAC

GTGAAAGACACGGCGGTCACTACCAAAGCCTACGCTAACAATGGCACTAC

CTTGGATGTGAGCGGATTGGATGATGCAGCAATCAAGGCTGCTACCGGCG

GTACGAACGGAACCGCGTCCGTGACCGGCGGTGCCGTGAAGTTCGATGCT

GACAACAATAAGTATTTCGTCACCATTGGAGGCTTTACTGGCGCCGACGC

AGCAAAGAACGGCGACTATGAAGTGAACGTGGCAACCGATGGAACCGTGA

CGCTGGCCGCTGGTGCCACCAAGACCACCATGCCAGCCGGCGCCACAACT

AAGACCGAGGTGCAGGAGTTAAAGGACACCCCCGCGGTGGTTAGCGCAGA

TGCCAAAAACGCCTTGATCGCCGGCGGAGTGGATGCAACTGATGCTAATG

GTGCGGAGCTGGTTAAAATGTCGTATACAGACAAGAATGGTAAGACGATC

GAGGGCGGTTATGCCCTTAAGGCAGGAGATAAGTATTACGCTGCTGATTA

CGATGAGGCGACGGGAGCTATTAAGGCCAAGACAACGTCATACACGGCGG

CGGACGGAACGACTAAGACGGCTGCCAATCAGTTGGGAGGGGTTGACGGG

AAGACAGAGGTCGTTACGATCGATGGCAAGACATACAACGCTTCCAAGGC

CGCTGGCCACGATTTCAAAGCTCAACCCGAACTGGCCGAGGCCGCGGCGA

AAACAACTGAGAACCCGTTGCAGAAGATTGATGCGGCCCTGGCGCAAGTA

GATGCCCTGCGCTCAGACCTGGGCGCCGTTCAAAATCGATTCAATTCCGC

GATTACAAACCTGGGCAATACAGTAAACAATCTATCCGAGGCCAGATCCC

GCATTGAAGACTCCGACTACGCGACAGAAGTAAGTAACATGAGTCGTGCC

CAGATTCTGCAGCAGGCCGGCACTAGTGTCCTGGCCCAGGCCAATCAAGT

CCCGCAGAATGTGCTGAGCCTACTAGCATCAGGTTCCGGCTCAGGTTCCA

GCCACAACGGAAAGCTGTGCCGTCTGAAAGGCATAGCGCCACTGCAGCTC

GGCAAATGTAACATCGCAGGTTGGCTCCTTGGTAACCCGGAGTGCGACCC

CCTCCTCCCTGTACGATCCTGGAGTTATATCGTGGAGACCCCCAATAGCG

AGAACGGAATTTGCTACCCAGGAGATTTCATAGACTACGAGGAGTTGCGC

GAGCAGCTTTCGTCTGTGAGCAGCTTCGAAAGGTTCGAGATATTCCCGAA

GGAGAGCAGCTGGCCGAATCATAACACTAACGGTGTGACAGCCGCCTGCA

GTCATGAAGGAAAGAGTTCATTCTATCGCAACCTGCTGTGGTTGACGGAG

AAAGAGGGCAGCTACCCTAAGTTGAAGAACTCCTATGTGAACAAAAAAGG

-continued

CAAGGAGGTTCTGGTGCTGTGGGGCATACACCACCCCCCCAATAGCAAGG

AGCAGCAGAATCTGTACCAAAACGAGAATGCCTATGTGAGCGTGGTCACT

AGTAACTATAACCGTCGGTTCACTCCCGAGATCGCCGAGCGTCCGAAGGT

GAGGGACCAGGCAGGCCGGATGAACTACTACTGGACCCTATTGAAGCCAG

GGGACACGATTATCTTCGAGGCAAACGGAAACCTCATAGCGCCGATGTAC

GCCTTCGCCCTGAGCCGTGGCTTTGGATCGGGGATCATCACGTCTAACGC

CTCGATGCACGAATGTAATACCAAATGCCAGACCCCACTGGGTGCTATCA

ACTCGTCCTTACCCTATCAAAATATACATCCGGTCACCATAGGCGAGTGT

CCCAAATATGTCAGACACCATCATCACCACCATTAATAG

SEQ ID N0:105 FOR PRIMER
AGTCGCTGAGCCTACTAGCATCAGGTTCCGGCTCAGGTTCCAGCCACAAC

GGAAAGCTGTGCCGTC

SEQ ID NO: 106 REV PRIMER
AGTCGCATGCCTATTAATGGTGGTGATGATGGTGTCTGACATATTTGGGA

CACTCGCCTATGGTGAC

SEQ ID NO: 107 STF2.HA1-2
ATGAAATTCTTAGTCAACGTTGCCCTTGTTTTTATGGTCGTATACATTTC

TTACATCTATGCGGCCCAGGTTATCAATACCAACTCCCTGTCGTTGCTCA

CCCAAAATAACCTTAATAAAAGCCAGAGCGCACTGGGAACCGCCATAGAA

CGCCTCTCAAGCGGCCTCCGGATCAATTCTGCAAAAGACGACGCCGCCGG

TCAGGCCATCGCAAACCGCTTTACCGCCAATATCAAGGGACTGACGCAGG

CTTCGAGGAATGCTAACGATGGGATAAGCATCGCTCAAACCACGGAGGGC

GCCCTGAACGAGATCAACAACAACCTACAGCGCGTCAGGGAGCTCGCAGT

GCAGTCCGCCAATTCGACCAACTCGCAGTCGGACCTGGACTCGATCCAAG

CCGAAATCACCCAGCGCCTGAACGAGATTGACCGGGTGAGCGGTCAGACA

CAGTTTAACGGCGTGAAGGTACTTGCGCAGGATAACACACTTACGATACA

GGTGGGCGCCAACGATGGTGAAACCATAGACATTGATCTCAAACAGATTA

ACAGCCAGACGCTCGGGTTGGATAGCCTGAATGTGCAAAAGGCGTACGAC

GTGAAAGACACGGCGGTCACTACCAAAGCCTACGCTAACAATGGCACTAC

CTTGGATGTGAGCGGATTGGATGATGCAGCAATCAAGGCTGCTACCGGCG

GTACGAACGGAACCGCGTCCGTGACCGGCGGTGCCGTGAAGTTCGATGCT

GACAACAATAAGTATTTCGTCACCATTGGAGGCTTTACTGGCGCCGACGC

AGCAAAGAACGGCGACTATGAAGTGAACGTGGCAACCGATGGAACCGTGA

CGCTGGCCGCTGGTGCCACCAAGACCACCATGCCAGCCGGCGCCACAACT

AAGACCGAGGTGCAGGAGTTAAAGGACACCCCCGCGGTGGTTAGCGCAGA

TGCCAAAAACGCGTTGATCGCCGGCGGAGTGGATGCAACTGATGCTAATG

GTGCGGAGCTGGTTAAAATGTCGTATACAGACAAGAATGGTAAGACGATC

GAGGGCGGTTATGCCCTTAAGGCAGGAGATAAGTATTACGCTGCTGATTA

CGATGAGGCGACGGGAGCTATTAAGGCCAAGACAACGTCATACACGGCGG

CGGACGGAACGACTAAGACGGCTGCCAATCAGTTGGGAGGGGTTGACGGG

AAGACAGAGGTCGTTACGATCGATGGCAAGACATACAACGCCTCCAAGGC

CGCTGGCCACGATTTCAAAGCTCAACCCGAACTGGCCGAGGCCGCGGCGA

-continued

AAACAACTGAGAACCCGTTGCAGAAGATTGATGCGGCCCTGGCGCAAGTA

GATGCCCTGCGCTCAGACCTGGGCGCCGTTCAAAATCGATTCAATTCCGC

GATTACAAACCTGGGCAATACAGTAAACAATCTATCCGAGGCCAGATCCC

GCATTGAAGACTCCGACTACGCGACAGAAGTAAGTAACATGAGTCGTGCC

CAGATTCTGCAGCAGGCCGGCACTAGTGTCCTGGCCCAGGCCAATCAAGT

CCCGCAGAATGTGCTGAGCCTACTAGCATCAGGTTCCGGCTCAGGTTCCA

AAGGCATAGCGCCACTGCAGCTCGGCAAATGTAACATCGCAGGTTGGCTC

CTTGGTAACCCGGAGTGCGACCCCCTCCTCCCTGTACGATCCTGGAGTTA

TATCGTGGAGACCCCCAATAGCGAGAACGGAATTTGCTACCCAGGAGATT

TCATAGACTACGAGGAGTTGCGCGAGCAGCTTTCGTCTGTGAGCAGCTTC

GAGAGGTTCGAAATCTTCCCGAAGGAGAGCAGCTGGCCGAATCATAACAC

TAACGGTGTGACAGCCGCCTGCAGTCATGAAGGAAAGAGTTCATTCTATC

GCAACCTGCTGTGGTTGACGGAGAAAGAGGGCAGCTACCCTAAGTTGAAG

AACTCCTATGTGAACAAAAAAGGCAAGGAGGTTCTGGTGCTGTGGGGCAT

ACACCACCCCCCCAATAGCAAGGAGCAGCAGAATCTGTACCAAAACGAGA

ATGCCTATGTGAGCGTGGTCACTAGTAACTATAACCGTCGGTTCACTCCC

GAGATCGCCGAGCGTCCGAAGGTGAGGGACCAGGCAGGCCGGATGAACTA

CTACTGGACCCTATTGAAGCCAGGGGACACGATTATCTTCGAGGCAAACG

GAAACCTCATAGCGCCGATGTACGCGTTCGCCCTGAGCCGTGGCTTTGGA

TCGGGGATCATCACGTCTCACCATCATCACCACCATTAATAG

SEQ ID NO: 108 FOR PRIMER
AGTCGCTGAGCCTACTAGCATCAGGTTCCGGCTCAGGTTCCAAAGGCATA

GCGCCACTGCAGCTCG

SEQ ID NO: 109 REV PRIMER
AGTCGCATGCCTATTAATGGTGGTGATGATGGTGAGACGTGATGATCCCC

GATCCAAAGCCACGGCTCAG

SEQ ID NO: 110 STF2.HA1-2mut
ATGAAATTCTTAGTCAACGTTGCCCTTGTTTTTATGGTCGTATACATTTC

TTACATCTATGCGGCCCAGGTTATCAATACCAACTCCCTGTCGTTGCTCA

CCCAAAATAACCTTAATAAAAGCCAGAGCGCACTGGGAACCGCCATAGAA

CGCCTCTCAAGCGGCCTCCGGATCAATTCTGCAAAAGACGACGCCGCCGG

TCAGGCCATCGCAAACCGCTTTACCGCCAATATCAAGGGACTGACGCAGG

CTTCGAGGAATGCTAACGATGGAATAAGCATCGCTCAAACCACGGAGGGC

GCCCTGAACGAGATCAACAACAACCTACAGCGCGTCAGGGAGCTCGCAGT

GCAGTCCGCCAATTCGACCAACTCGCAGTCGGACCTGGACTCGATCCAAG

CCGAAATCACCCAGCGCCTGAATGAGATTGACCGGGTGAGCGGTCAGACA

CAGTTTAACGGCGTGAAGGTACTTGCACAGGATAACACACTTACGATACA

GGTGGGCGCCAACGATGGTGAAACCATAGACATTGATCTCAAACAGATTA

ACAGCCAGACGCTCGGGTTGGATAGCCTGAATGTGCAAAAGGCGTACGAC

GTGAAAGACACGGCGGTCACTACCAAAGCCTACGCTAACAATGGCACTAC

CTTGGATGTGAGCGGATTGGATGATGCAGCAATCAAGGCTGCTACCGGCG

GTACGAACGGAACCGCGTCCGTGACCGGCGGTGCCGTGAAGTTCGATGCT

-continued

GACAACAATAAGTATTTCGTCACCATTGGAGGCTTTACTGGCGCCGACGC
AGCAAAGAACGGCGACTATGAAGTGAACGTGGCAACCGATGGAACCGTGA
CGCTGGCCGCTGGTGCCACCAAGACCACCATGCCAGCCGGCGCCACAACT
AAGACCGAGGTGCAGGAGTTAAAGGACACCCCCGCGGTGGTTAGCGCAGA
TGCCAAAAACGCGTTGATCGCCGGCGGAGTGGATGCAACTGATGCTAATG
GTGCGGAGCTGGTTAAAATGTCGTATACAGACAAGAATGGTAAGACGATC
GAGGGCGGTTATGCCCTTAAGGCAGGAGATAAGTATTACGCTGCTGATTA
CGATGAGGCGACGGGAGCTATTAAGGCCAAGACAACGTCATACACGGCGG
CGGACGGAACGACTAAGACGGCTGCCAATCAGTTGGGAGGGGTTGACGGG
AAGACAGAGGTCGTTACGATCGATGGCAAGACATACAACGCCTCCAAGGC
CGCTGGCCACGATTTCAAAGCTCAACCCGAACTGGCCGAGGCCGCGGCGA
AAACAACTGAGAACCCGTTGCAGAAGATTGATGCGGCCCTGGCGCAAGTA
GATGCCCTGCGCTCAGACCTGGGCGCCGTTCAAAATCGATTCAATTCCGC
GATTACAAACCTGGGCAATACAGTAAACAATCTATCCGAGGCCAGATCCC
GCATTGAAGACTCCGACTACGCGACAGAAGTAAGTAACATGAGTCGTGCC
CAGATTCTGCAGCAGGCCGGCACTAGTGTCCTGGCCCAGGCCAATCAAGT
CCCGCAGAATGTGCTGAGCCTGCTGGCTTCTGGATCTGGATCTGGTTCTA
AAGGCGCTGCCCCTCTGCAACTCGGCAAGTGCAATATTGCGGGGTGGCTG
TTGGGCAACCCAGAATGTGACCCCCTCCTGCCCGTCCGTTCTTGGTCTGA
CATCGCTGAAACACCTAACTCCGAGAACGGCATCTGTTACCCGGGCGACT
TCATTGACTACGAGGAGCTCCGCGAACAGCTGTCTTCTGTCTCTTCTTTC
GAACGTTTCGAAATTTTCCCAAAGGAATCCTCCTGGCCAAACCATAACAC
CAACGGAGTGACCGCCGCCTGTAGCCATGAGGGCAAGTCTTCTTTCTACC
GTAATCTGCTGTGGCTGACTGAAAAAGAGGGTTCTTATCCCAAACTGAAG
AACTCTTATCTCAACAAGAAGGGCAAAGAGGTCCTGGTGCTGTGGGGTAT
CCACCACCCCCCCAACTCCAAGGAGCAGCAGAATCTGTACCAAAACGAAA
ATGCTTACGTGTCTGTCGTGACATCTAACTACAACCGGCGCTTCACGCCC
GAAATCGCCGAGCGTCCCAAAGTGCGCGATCAGGCCGGAAGGATGAACTA
CTACTGGACCCTGCTCAAACCCGGAGATACCATCATATTCGAAGCCAATG
GCAATCTCATCGCTCCCATGTATGCTTTCGCTCTCTCTCGCGGATTCGGT
TCCGGCATAATCACTAGCCACCACCACCACCACCACTAATAG

SEQ ID NO: 111 HA1-2mut
AAGGCGCTGCCCCTCTGCAACTCGGCAAGTGCAATATTGCGGGGTGGCTG
TTGGGCAACCCAGAATGTGACCCCCTCCTGCCCGTCCGTTCTTGGTCTGA
CATCGCTGAAACACCTAACTCCGAGAACGGCATCTGTTACCCGGGCGACT
TCATTGACTACGAGGAGCTCCGCGAACAGCTGTCTTCTGTCTCTTCTTTC
GAACGTTTCGAAATTTTCCCAAAGGAATCCTCCTGGCCAAACCATAACAC
CAACGGAGTGACCGCCGCCTGTAGCCATGAGGGCAAGTCTTCTTTCTACC
GTAATCTGCTGTGGCTGACTGAAAAAGAGGGTTCTTATCCCAAACTGAAG
AACTCTTATGTCAACAAGAAGGGCAAAGAGGTCCTGGTGCTGTGGGGTAT
CCACCACCCCCCCAACTCCAAGGAGCAGCAGAATCTGTACCAAAACGAAA -continued ATGCTTACGTGTCTGTCGTGACATCTAACTACAACCGGCGCTTCACGCCC
GAAATCGCCGAGCGTCCCAAAGTGCGCGATCAGGCCGGAAGGATGAACTA
CTACTGGACCCTGCTCAAACCCGGAGATACCATCATATTCGAAGCCAATG
GCAATCTCATCGCTCCCATGTATGCTTTCGCTCTCTCTCGCGGATTCGGT
TCCGGCATAATCACTAGCCACCACCACCACCACCACTAATAG SEQ ID NO: 112 STF2.HA1-3
ATGAAATTCTTAGTCAACGTTGCCCTTGTTTTTATGGTCGTATACATTTC
TTACATCTATGCGGCCCAGGTTATCAATACCAACTCCCTGTCGTTGCTCA
CCCAAAATAACCTTAATAAAAGCCAGAGCGCACTGGGAACCGCCATAGAA
CGCCTCTCAAGCGGCCTCCGGATCAATTCTGCAAAAGACGACGCCGCCGG
TCAGGCCATCGCAAACCGCTTTACCGCCAATATCAAGGGACTGACGCAGG
CTTCGAGGAATGCTAACGATGGGATAAGCATCGCTCAAACCACGGAGGGC
GCCCTGAACGAGATCAACAACAACCTACAGCGCGTCAGGGAGCTCGCAGT
GCAGTCCGCCAATTCGACCAACTCGCAGTCGGACCTGGACTCGATCCAAG
CCGAAATCACCCAGCGCCTGAACGAGATTGACCGGGTGAGCGGTCAGACA
CAGTTTAACGGCGTGAAGGTACTTGCGCAGGATAACACACTTACGATACA
GGTGGGCGCCAACGATGGTGAAACCATAGACATTGATCTCAAACAGATTA
ACAGCCAGACGCTCGGGTTGGATAGCCTGAATGTGCAAAAGGCGTACGAC
GTGAAAGACACGGCGGTCACTACCAAAGCCTACGCTAACAATGGCACTAC
CTTGGATGTGAGCGGATTGGATGATGCAGCAATCAAGGCTGCTACCGGCG
GTACGAACGGAACCGCGTCCGTGACCGGCGGTGCCGTGAAGTTCGATGCT
GACAACAATAAGTATTTCGTCACCATTGGAGGCTTTACTGGCGCCGACGC
AGCAAAGAACGGCGACTATGAAGTGAACGTGGCAACCGATGGAACCGTGA
CGCTGGCCGCTGGTGCCACCAAGACCACCATGCCAGCCGGCGCCACAACT
AAGACCGAGGTGCAGGAGTTAAAGGACACCCCCGCGGTGGTTAGCGCAGA
TGCCAAAAACGCGTTGATCGCCGGCGGAGTGGATGCAACTGATGCTAATG
GTGCGGAGCTGGTTAAAATGTCGTATACAGACAAGAATGGTAAGACGATC
GAGGGCGGTTATGCCCTTAAGGCAGGAGATAAGTATTACGCTGCTGATTA
CGATGAGGCGACGGGAGCTATTAAGGCCAAGACAACGTCATACACGGCGG
CGGACGGAACGACTAAGACGGCTGCCAATCAGTTGGGAGGGGTTGACGGG
AAGACAGAGGTCGTTACGATCGATGGCAAGACATACAACGCCTCCAAGGC
CGCTGGCCACGATTTCAAAGCTCAACCCGAACTGGCCGAGGCCGCGGCGA
AAACAACTGAGAACCCGTTGCAGAAGATTGATGCGGCCCTGGCGCAAGTA
GATGCCCTGCGCTCAGACCTGGGCGCCGTTCAAAATCGATTCAATTCCGC
GATTACAAACCTGGGCAATACAGTAAACAATCTATCCGAGGCCAGATCCC
GCATTGAAGACTCCGACTACGCGACAGAAGTAAGTAACATGAGTCGTGCC
CAGATTCTGCAGCAGGCCGGCACTAGTGTCCTGGCCCAGGCCAATCAAGT
CCCGCAGAATGTGCTGAGCCTACTAGCATCAGGTTCCGGCTCAGGTTCCA
ATAGCGAGAACGGAATTTGCTACCCAGGAGATTTCATAGACTACGAGGAG
TTGCGCGAGCAGCTTTCGTCTGTGAGCAGCTTCGAGAGGTTCGAAATCTT
CCCGAAGGAGAGCAGCTGGCCGAATCATAACACTAACGGTGTGACAGCCG -continued

CCTGCAGTCATGAAGGAAAGAGTTCATTCTATCGCAACCTGCTGTGGTTG

ACGGAGAAGGAGGGCAGCTACCCTAAGCTGAAGAACTCCTATGTGAACAA

AAAAGGCAAGGAGGTTCTGGTGCTGTGGGGCATACACCACCCCCCCAATA

GCAAGGAGCAGCAGAATCTGTACCAAAACGAGAATGCCTATGTGAGCGTG

GTCACTAGTAACTATAACCGTCGGTTCACTCCCGAGATCGCCGAGCGTCC

GAAGGTGAGGGACCAGGCAGGCCGGATGAACTACTACTGGACCCTATTGA

AGCCAGGGGACACGATTATCTTCGAGGCAAACGGAAACCTCATAGCGCCG

ATGTACGCCTTCGCCCTGAGCCGTGGCCACCATCATCACCACCATTAATA

G

SEQ ID NO: 113 FOR PRIMER
AGTCGCTGAGCCTACTAGCATCAGGTTCCGGCTCAGGTTCCAATAGCGAG

AACGGAATTTGCTACC

SEQ ID NO: 114 REV PRIMER
AGTCGCATGCCTATTAATGGTGGTGATGATGGTGGCCACGGCTCAGGGCG

AAGG

SEQ ID NO: 115 STF2.HA1-3mut
ATGAAATTCTTAGTCAACGTTGCCCTTGTTTTTATGGTCGTATACATTTC

TTACATCTATGCGGCCCAGGTTATCAATACCAACTCCCTGTCGTTGCTCA

CCCAAAATAACCTTAATAAAAGCCAGAGCGCACTGGCAACCGCCATAGAA

CGCCTCTCAAGCGGCCTCCGGATCAATTCTGCAAAAGACGACGCCGCCGG

TCAGGCCATCGCAAACCGCTTTACCGCCAATATCAAGGGACTGACGCAGG

CTTCGAGGAATGCTAACGATGGAATAAGCATCGCTCAAACCACGGAGGGC

GCCCTGAACGAGATCAACAACAACCTACAGCGCGTCAGGGAGCTCGCAGT

GCAGTCCGCCAATTCGACCAACTCGCAGTCGGACCTGGACTCGATCCAAG

CCGAAATCACCCAGCGCCTGAATGAGATTGACCGGGTGAGCGGTCAGACA

CAGTTTAACGGCGTGAAGGTACTTGCACAGGATAACACACTTACGATACA

GGTGGGCGCCAACGATGGTGAAACCATAGACATTGATCTCAAACAGATTA

ACAGCCAGACGCTCGGGTTGGATAGCCTGAATGTGCAAAAGGCGTACGAC

GTGAAAGACACGGCGGTCACTACCAAAGCCTACGCTAACAATGGCACTAC

CTTGGATGTGAGCGGATTGGATGATGCAGCAATCAAGGCTGCTACCGGCG

GTACGAACGGAACCGCGTCCGTGACCGGCGGTGCCGTGAAGTTCGATGCT

GACAACAATAAGTATTTCGTCACCATTGGAGGCTTTACTGGCGCCGACGC

AGCAAAGAACGGCGACTATGAAGTGAACGTGGCAACCGATGGAACCGTGA

CGCTGGCCGCTGGTGCCACCAAGACCACCATGCCAGCCGGCGCCACAACT

AAGACCGAGGTGCAGGAGTTAAAGGACACCCCCGCGGTGGTTAGCGCAGA

TGCCAAAAACGCGTTGATCGCCGGCGGAGTGGATGCAACTGATGCTAATG

GTGCGGAGCTGGTTAAAATGTCGTATACAGACAAGAATGGTAAGACGATC

GAGGGCGGTTATGCCCTTAAGGCAGGAGATAAGTATTACGCTGCTGATTA

CGATGAGGCGACGGGAGCTATTAAGGCCAAGACAACGTCATACACGGCGG

CGGACGGAACGACTAAGACGGCTGCCAATCAGTTGGGAGGGGTTGACGGG

AAGACAGAGGTCGTTACGATCGATGGCAAGACATACAACGCCTCCAAGGC

CGCTGGCCACGATTTCAAAGCTCAACCCGAACTGGCCGAGGCCGCGGCGA

AAACAACTGAGAACCCGTTGCAGAAGATTGATGCGGCCCTGGCGCAAGTA

GATGCCCTGCGCTCAGACCTGGGCGCCGTTCAAAATCGATTCAATTCCGC

GATTACAAACCTGGGCAATACAGTAAACAATCTATCCGAGGCCAGATCCC

GCATTGAAGACTCCGACTACGCGACAGAAGTAAGTAACATGAGTCGTGCC

CAGATTCTGCAGCAGGCCGGCACTAGTGTCCTGGCCCAGGCCAATCAAGT

CCCGCAGAATGTGCTGAGCCTGCTGGCTTCTGGATCTGGATCTGGTTCTA

ACTCCGAGAACGAAATCTGTTACCCGGGCGACTTCATTGACAAAGAGGAG

CTCCGCGAACAGCTGTCTTCTGTCTCTTCTTTCGAACGTTTCGAAATTTT

CCCAAAGGAATCCTCCTGGCCAAACCATAACACCAACGGAGTGACCGCCG

CCTGTAGCCATGAGGGCAAGTCTTCTTTCTACCGTAATCTGCTGTGGCTG

ACTGAAAAAGAGGGTTCTTATCCCAAACTGAAGAACTCTTATGTCAACAA

GAAGGGCAAAGAGGTCCTGGTGCTGTGGGGTATCCACCACCCCCCCAACT

CCAAGGAGCAGCAGAATCTGTACCAAAACGAAAATGCTTACGTGTCTGTC

GTGACATCTAACTACAACCGGCGCTTCACGCCCGAAATCGCCGAGCGTCC

CAAAGTGCGCGATCAGGCCGGAAGGATGAACTACTACTGGACCCTGCTCA

AACCCGGAGATACCATCATATTCGAAGCCAATGGCAATCTCATCGCTCCC

ATGTATGCTGCTGCTCTCTCTCGCGGACACCACCACCACCACCACTAATA

G

SEQ ID NO: 116 HA1-3mut PR8
AACTCCGAGAACGAAATCTGTTACCCGGGCGACTTCATTGACAAAGAGGA

GCTCCGCGAACAGCTGTCTTCTGTCTCTTCTTTCGAACGTTTCGAAATTT

TCCCAAAGGAATCCTCCTGGCCAAACCATAACACCAACGGAGTGACCGCC

GCCTGTAGCCATGAGGGCAAGTCTTCTTTCTACCGTAATCTGCTGTGGCT

GACTGAAAAAGAGGGTTCTTATCCCAAACTGAAGAACTCTTATGTCAACA

AGAAGGGCAAAGAGGTCCTGGTGCTGTGGGGTATCCACCACCCCCCCAAC

TCCAAGGAGCAGCAGAATCTGTACCAAAACGAAAATGCTTACGTGTCTGT

CGTGACATCTAACTACAACCGGCGCTTCACGCCCGAAATCGCCGAGCGTC

CCAAAGTGCGCGATCAGGCCGGAAGGATGAACTACTACTGGACCCTGCTC

AAACCCGGAGATACCATCATATTCGAAGCCAATGGCAATCTCATCGCTCC

CATGTATGCTGCTGCTCTCTCTCGCGGACACCACCACCACCACCACTAAT

AG

SEQ ID NO: 117 ngSTF2.HA0s
ATGAAATTCTTAGTCAACGTTGCCCTTGTTTTTATGGTCGTATACATTTC

TTACATCTATGCGGCCCAAGTGATCAACACCAACTCCCTGTCCCTGCTCA

CTCAAAACAACCTCCAGAAATCTCAGTCTGCTCTCGGTACTGCTATCGAG

CGTCTCTCCTCCGGCCTGAGGATCAACTCCGCTAAAGATGACGCCGCCGG

ACAAGCTATCGCTAACCGCTTTACTGCCAACATTAAAGGCCTGACCCAAG

CCTCTAGGAACGCCAATGATGGCATTTCTATCGCTCAAACCACCGAAGGC

GCCCTGAACGAAATCAATAATAACCTGCAACGTGTCCGCGAACTCGCCGT

CCAGTCCGCCCAATCTACCAACTCTCAGTCTGACCTGGACTCTATCCAAG

CTGAGATCACCCAAAGGCTCAACGAGATCGATCGTGTGTCTGGTCAAACT

CAGTTTAACGGCGTCAAAGTGCTGGCTCAAGACAACACACTCACCATCCA

-continued

AGTAGGAGCCAATGACGGCGAGACAATCGATATCGACCTGAAGCAGATCA
ATTCTCAAACTCTGGGCCTGGACTCCCTGAACGTCCAAAAGGCTTACGAC
GTGAAGGACACCGCTGTGACAACCAAAGCCTATGCTAATCAAGGAACAAC
CCTGGACGTGTCCGGACTCGATGACGCCGCTATCAAGGCCGCTACTGGCG
GCACTCAGGGAACTGCCTCTGTGACCGGAGGCGCTGTGAAGTTCGACGCC
GATAACAACAAATACTTCGTCACTATTGGTGGTTTCACTGGCGCTGACGC
CGCTAAGAACGGTGACTACGAGGTCAACGTCGCCACTGACGGAACAGTGA
CACTGGCCGCTGGCGCTACCAAGACCACAATGCCTGCTGGTGCTACTACT
AAGACAGAGGTGCAGGAACTCAAGGACACCCCTGCCGTGGTGTCCGCCGA
TGCTAAGAACGCTCTCATTGCTGGTGGTGTCGACGCTACGGACGCCAACG
GAGCCGAGCTTGTGAAAATGTCCTACACCGACAAGAACGGAAAGACTATC
GAGGGAGGTTACGCTCTGAAGGCTGGCGATAAGTACTACGCCGCTGATTA
TGACGAAGCTACAGGCGCCATTAAAGCTAAAACCACATCTTATACCGCTG
CCGATGGTACTACCAAGACTGCTGCCAATCAGCTGGGTGGAGTCGATGGA
AAAACCGAAGTGGTCACAATCGACGGAAAGACCTATCAAGCCTCCAAGGC
TGCTGGCCACGACTTCAAGGCCCAACCCGAACTGGCCGAGGCTGCTGCTA
AAACCACTGAAAACCCCCTGCAGAAAATTGACGCTGCCCTGGCCCAAGTG
GATGCCCTCCGCTCCGACCTCGGCGCTGTGCAAAACCGCTTCAACTCCGC
TATTACAAACCTCGGCAATACCGTCAATCAACTCTCTGAAGCTAGGTCTC
GTATTGAGGATTCCGATTACGCTACCGAGGTCTCCCAGATGTCCCGTGCC
CAAATTCTCCAACAAGCCGGCACCTCCGTCCTCGCCCAAGCCAATCAGGT
GCCACAGAATGTGCTGAGCCTGCTGGCTTCTGGATCTGGATCTGGTTCTG
ACACCATCTGCATTGGCTACCATGCCCAGCAGTCTACAGATACAGTCGAT
ACCGTCCTGGAGAAACAAGTCACCGTCACGCACTCCGTGAACCTCCTGGA
GGACTCCCATAATGGCAAATTGTGTCGGCTGAAAGGCATCGCCCCTCTGC
AACTCGGCAAGTGCAATATTGCGGGGTGGCTGTTGGGCAACCCAGAATGT
GACCCCCTCCTGCCCGTCCGTTCTTGGTCTTACATCGTGGAAACACCTAA
CTCCGAGAACGGCATCTGTTACCCGGGCGACTTCATTGACTACGAGGAGC
TCCGCGAACAGCTGTCTTCTGTCTCTTCTTTCGAACGTTTCGAAATTTTC
CCAAAGGAATCCTCCTGGCCAAACCATAACACCAACGGAGTGACCGCCGC
CTGTAGCCATGAGGGCAAGTCTTCTTTCTACCGTAATCTGCTGTGGCTGA
CTGAAAAAGAGGGTTCTTATCCCAAACTGAAGAACTCTTATGTCAACAAG
AAGGGCAAAGAGGTCCTGGTGCTGTGGGGTATCCACCACCCCCCCAACTC
CAAGGAGCAGCAGAATCTGTACCAAAACGAAAATGCTTACGTGTCTGTCG
TGACATCTAACTACAACCGGCGCTTCACGCCCGAAATCGCCGAGCGTCCC
AAAGTGCGCGATCAGGCCGGAAGGATGAACTACTACTGGACCCTGCTCAA
ACCCGGAGATACCATCATATTCGAAGCCAATGGCAATCTCATCGCTCCCA
TGTATGCTTTCGCTCTCTCTCGCGGATTCGGTTCCGGCATAATCACTAGC
CAAGCCTCCATGCACGAGTGCAATACCAAGTGTCAAACTCCACTGGGAGC
CATTCAAAGCTCCCTGCCCTACCAAAACATCCATCCTGTGACCATTGGAG

-continued

AGTGCCCTAAATACGTGCGCAGCGCGAAACTGCGCATGGTGACCGGTCTC
CGCAATATACCCTCCATACAATCGCGCGGCCTGTTTGGTGCTATCGCTGG
CTTTATCGAGGGAGGATGGACTGGAATGATCGACGGCTGGTATGGCTATC
ATCATCAAAACGAACAGGGTTCCGGCTACGCCGCTGACCAAAAGTCCACT
CAAAACGCCATTAACGGTATTACAAACAAAGTAAACACCGTGATAGAGAA
AATGAATATCCAATTCACTGCCGTGGGCAAAGAGTTTAACAAGCTGGAGA
AGCGCATGGAAAATCTGAACAAAAAAGTCGATGATGGCTTCCTCGACATC
TGGACTTACAACGCCGAACTCCTCGTGCTGCTCGAAAACGAGAGGACTCT
GGACTTCCACGACTCCAACGTGAAGAACCTGTACGAGAAAGTCAAATCCC
AACTCAAGAACAACGCCAAAGAAATCGGCAACGGCTGCTTCGAGTTCTAC
CACAAATGTGATAACGAGTGTATGGAATCCGTACGGCAAGGCACTTACGA
CTACCCCAAATACAGCGAAGAGAGCAAATTGAACCGCGAGAAAGTGGACG
GCGTGAAACTGGAGTCCATGGGCATCTATCAGCACCACCACCACCACCAC
TAATAG

SEQ ID NO: 118 ngHA0s
GACACCATCTGCATTGGCTACCATGCCCAGCAGTCTACAGATACAGTCGA
TACCGTCCTGGAGAAACAAGTCACCGTCACGCACTCCGTGAACCTCCTGG
AGGACTCCCATAATGGCAAATTGTGTCGGCTGAAAGGCATCGCCCCTCTG
CAACTCGGCAAGTGCAATATTGCGGGGTGGCTGTTGGGCAACCCAGAATG
TGACCCCCTCCTGCCCGTCCGTTCTTGGTCTTACATCGTGGAAACACCTA
ACTCCGAGAACGGCATCTGTTACCCGGGCGACTTCATTGACTACGAGGAG
CTCCGCGAACAGCTGTCTTCTGTCTCTTCTTTCGAACGTTTCGAAATTTT
CCCAAAGGAATCCTCCTGGCCAAACCATAACACCAACGGAGTGACCGCCG
CCTGTAGCCATGAGGGCAAGTCTTCTTTCTACCGTAATCTGCTGTGGCTG
ACTGAAAAAGAGGGTTCTTATCCCAAACTGAAGAACTCTTATGTCAACAA
GAAGGGCAAAGAGGTCCTGGTGCTGTGGGGTATCCACCACCCCCCCAACT
CCAAGGAGCAGCAGAATCTGTACCAAAACGAAAATGCTTACGTGTCTGTC
GTGACATCTAACTACAACCGGCGCTTCACGCCCGAAATCGCCGAGCGTCC
CAAAGTGCGCGATCAGGCCGGAAGGATGAACTACTACTGGACCCTGCTCA
AACCCGGAGATACCATCATATTCGAAGCCAATGGCAATCTCATCGCTCCC
ATGTATGCTTTCGCTCTCTCTCGCGGATTCGGTTCCGGCATAATCACTAG
CCAAGCCTCCATGCACGAGTGCAATACCAAGTGTCAAACTCCACTGGGAG
CCATTCAAAGCTCCCTGCCCTACCAAAACATCCATCCTGTGACCATTGGA
GAGTGCCCTAAATACGTGCGCAGCGCGAAACTGCGCATGGTGACCGGTCT
CCGCAATATACCCTCCATACAATCGCGCGGCCTGTTTGGTGCTATCGCTG
GCTTTATCGAGGGAGGATGGACTGGAATGATCGACGGCTGGTATGGCTAT
CATCATCAAAACGAACAGGGTTCCGGCTACGCCGCTGACCAAAAGTCCAC
TCAAAACGCCATTAACGGTATTACAAACAAAGTAAACACCGTGATAGAGA
AAATGAATATCCAATTCACTGCCGTGGGCAAAGAGTTTAACAAGCTGGAG
AAGCGCATGGAAAATCTGAACAAAAAAGTCGATGATGGCTTCCTCGACAT
CTGGACTTACAACGCCGAACTCCTCGTGCTGCTCGAAAACGAGAGGACTC

-continued

TGGACTTCCACGACTCCAACGTGAAGAACCTGTACGAGAAAGTCAAATCC

CAACTCAAGAACAACGCCAAAGAAATCGGCAACGGCTGCTTCGAGTTCTA

CCACAAATGTGATAACGAGTGTATGGAATCCGTACGGCAAGGCACTTACG

ACTACCCCAAATACAGCGAAGAGAGCAAATTGAACCGCGAGAAAGTGGAC

GGCGTGAAACTGGAGTCCATGGGCATCTATCAGCACCACCACCACCACCA

CTAATAG

SEQ ID NO: 119 ngSTF2.HA1-1

ATGAAATTCTTAGTCAACGTTGCCCTTGTTTTTATGGTCGTATACATTTC

TTACATCTATGCGGCCCAAGTGATCAACACCAACTCCCTGTCCCTGCTCA

CTCAAAACAACCTCCAGAAATCTCAGTCTGCTCTCGGTACTGCTATCGAG

CGTCTCTCCTCCGGCCTGAGGATCAACTCCGCTAAAGATGACGCCGCCGG

ACAAGCTATCGCTAACCGCTTTACTGCCAACATTAAAGGCCTGACCCAAG

CCTCTAGGAACGCCAATGATGGCATTTCTATCGCTCAAACCACCGAAGGC

GCCCTGAACGAAATCAATAATAACCTGCAACGTGTCCGCGAACTCGCCGT

CCAGTCCGCCCAATCTACCAACTCTCAGTCTGACCTGGACTCTATCCAAG

CTGAGATCACCCAAAGGCTCAACGAGATCGATCGTGTGTCTGGTCAAACT

CAGTTTAACGGCGTCAAAGTGCTGGCTCAAGACAACACACTCACCATCCA

AGTAGGAGCCAATGACGGCGAGACAATCGATATCGACCTGAAGCAGATCA

ATTCTCAAACTCTGGGCCTGGACTCCCTGAACGTCCAAAAGGCTTACGAC

GTGAAGGACACCGCTGTGACAACCAAAGCCTATGCTAATCAAGGAACAAC

CCTGGACGTGTCCGGACTCGATGACGCCGCTATCAAGGCCGCTACTGGCG

GCACTCAGGGAACTGCCTCTGTGACCGGAGGCGCTGTGAAGTTCGACGCC

GATAACAACAAATACTTCGTCACTATTGGTGGTTTCACTGGCGCTGACGC

CGCTAAGAACGGTGACTACGAGGTCAACGTCGCCACTGACGGAACAGTGA

CACTGGCCGCTGGCGCTACCAAGACCACAATGCCTGCTGGTGCTACTACT

AAGACAGAGGTGCAGGAACTCAAGGACACCCCTGCCGTGGTGTCCGCCGA

TGCTAAGAACGCTCTCATTGCTGGTGGTGTCGACGCTACGGACGCCAACG

GAGCCGAGCTTGTGAAAATGTCCTACACCGACAAGAACGGAAAGACTATC

GAGGGAGGTTACGCTCTGAAGGCTGGCGATAAGTACTACGCCGCTGATTA

TGACGAAGCTACAGGCGCCATTAAAGCTAAAACCACATCTTATACCGCTG

CCGATGGTACTACCAAGACTGCTGCCAATCAGCTGGGTGGAGTCGATGGA

AAAACCGAAGTGGTCACAATCGACGGAAAGACCTATCAAGCCTCCAAGGC

TGCTGGCCACGACTTCAAGGCCCAACCCGAACTGGCCGAGGCTGCTGCTA

AAACCACTGAAAACCCCCTGCAGAAAATTGACGCTGCCCTGGCCCAAGTG

GATGCCCTCCGCTCCGACCTCGGCGCTGTGCAAAACCGCTTCAACTCCGC

TATTACAAACCTCGGCAATACCGTCAATCAGCTCTCTGAAGCTAGGTCTC

GTATTGAGGATTCCGATTACGCTACCGAGGTCTCCCAGATGTCCCGTGCC

CAAATTCTCCAACAAGCCGGCACCTCCGTCCTCGCCCAAGCCAATCAGGT

GCCACAGAATGTGCTGAGCCTGCTGGCTTCTGGATCTGGATCTGGTTCTT

CCCATAATGGCAAATTGTGTCGGCTGAAAGGCATCGCCCCTCTGCAACTC

GGCAAGTGCAATATTGCGGGGTGGCTGTTGGGCAACCCAGAATGTGACCC

-continued

CCTCCTGCCCGTCCGTTCTTGGTCTTACATCGTGGAAACACCTAACTCCG

AGAACGGCATCTGTTACCCGGGCGACTTCATTGACTACGAGGAGCTCCGC

GAACAGCTGTCTTCTGTCTCTTCTTTCGAACGTTTCGAAATTTTCCCAAA

GGAATCCTCCTGGCCAAACCATAACACCAACGGAGTGACCGCCGCCTGTA

GCCATGAGGGCAAGTCTTCTTTCTACCGTAATCTGCTGTGGCTGACTGAA

AAAGAGGGTTCTTATCCCAAACTGAAGAACTCTTATGTCAACAAGAAGGG

CAAAGAGGTCCTGGTGCTGTGGGGTATCCACCACCCCCCCAACTCCAAGG

AGCAGCAGAATCTGTACCAAAACGAAAATGCTTACGTGTCTGTCGTGACA

TCTAACTACAACCGGCGCTTCACGCCCGAAATCGCCGAGCGTCCCAAAGT

GCGCGATCAGGCCGGAAGGATGAACTACTACTGGACCCTGCTCAAACCCG

GAGATACCATCATATTCGAAGCCAATGGCAATCTCATCGCTCCCATGTAT

GCTTTCGCTCTCTCTCGCGGATTCGGTTCCGGCATAATCACTAGCCAAGC

CTCCATGCACGAGTGCAATACCAAGTGTCAAACTCCACTGGGAGCCATTC

AAAGCTCCCTGCCCTACCAAAACATCCATCCTGTGACCATTGGAGAGTGC

CCTAAATACGTGCGCCACCACCACCACCACCACTAATAG

SEQ ID NO: 120 ng HA1-1

TCCCATAATGGCAAATTGTGTCGGCTGAAAGGCATCGCCCCTCTGCAACT

CGGCAAGTGCAATATTGCGGGGTGGCTGTTGGGCAACCCAGAATGTGACC

CCCTCCTGCCCGTCCGTTCTTGGTCTTACATCGTGGAAACACCTAACTCC

GAGAACGGCATCTGTTACCCGGGCGACTTCATTGACTACGAGGAGCTCCG

CGAACAGCTGTCTTCTGTCTCTTCTTTCGAACGTTTCGAAATTTTCCCAA

AGGAATCCTCCTGGCCAAACCATAACACCAACGGAGTGACCGCCGCCTGT

AGCCATGAGGGCAAGTCTTCTTTCTACCGTAATCTGCTGTGGCTGACTGA

AAAAGAGGGTTCTTATCCCAAACTGAAGAACTCTTATGTCAACAAGAAGG

GCAAAGAGGTCCTGGTGCTGTGGGGTATCCACCACCCCCCCAACTCCAAG

GAGCAGCAGAATCTGTACCAAAACGAAAATGCTTACGTGTCTGTCGTGAC

ATCTAACTACAACCGGCGCTTCACGCCCGAAATCGCCGAGCGTCCCAAAG

TGCGCGATCAGGCCGGAAGGATGAACTACTACTGGACCCTGCTCAAACCC

GGAGATACCATCATATTCGAAGCCAATGGCAATCTCATCGCTCCCATGTA

TGCTTTCGCTCTCTCTCGCGGATTCGGTTCCGGCATAATCACTAGCCAAG

CCTCCATGCACGAGTGCAATACCAAGTGTCAAACTCCACTGGGAGCCATT

CAAAGCTCCCTGCCCTACCAAAACATCCATCCTGTGACCATTGGAGAGTG

CCCTAAATACGTGCGCCACCACCACCACCACCACTAATAG

SEQ ID NO: 121 ngSTF2.HA1-2

ATGAAATTCTTAGTCAACGTTGCCCTTGTTTTTATGGTCGTATACATTTC

TTACATCTATGCGGCCCAAGTGATCAACACCAACTCCCTGTCCCTGCTCA

CTCAAAACAACCTCCAGAAATCTCAGTCTGCTCTCGGTACTGCTATCGAG

CGTCTCTCCTCCGGCCTGAGGATCAACTCCGCTAAAGATGACGCCGCCGG

ACAAGCTATCGCTAACCGCTTTACTGCCAACATTAAAGGCCTGACCCAAG

CCTCTAGGAACGCCAATGATGGCATTTCTATCGCTCAAACCACCGAAGGC

GCCCTGAACGAAATCAATAATAACCTGCAACGTGTCCGCGAACTCGCCGT

CCAGTCCGCCCAATCTACCAACTCTCAGTCTGACCTGGACTCTATCCAAG

-continued

CTGAGATCACCCAAAGGCTCAACGAGATCGATCGTGTGTCTGGTCAAACT

CAGTTTAACGGCGTCAAAGTGCTGGCTCAAGACAACACACTCACCATCCA

AGTAGGAGCCAATGACGGCGAGACAATCGATATCGACCTGAAGCAGATCA

ATTCTCAAACTCTGGGCCTGGACTCCCTGAACGTCCAAAAGGCTTACGAC

GTGAAGGACACCGCTGTGACAACCAAAGCCTATGCTAATCAAGGAACAAC

CCTGGACGTGTCCGGACTCGATGACGCCGCTATCAAGGCCGCTACTGGCG

GCACTCAGGGAACTGCCTCTGTGACCGGAGGCGCTGTGAAGTTCGACGCC

GATAACAACAAATACTTCGTCACTATTGGTGGTTTCACTGGCGCTGACGC

CGCTAAGAACGGTGACTACGAGGTCAACGTCGCCACTGACGGAACAGTGA

CACTGGCCGCTGGCGCTACCAAGACCACAATGCCTGCTGGTGCTACTACT

AAGACAGAGGTGCAGGAACTCAAGGACACCCCTGCCGTGGTGTCCGCCGA

TGCTAAGAACGCTCTCATTGCTGGTGGTGTCGACGCTACGGACGCCAACG

GAGCCGAGCTTGTGAAAATGTCCTACACCGACAAGAACGGAAAGACTATC

GAGGGAGGTTACGCTCTGAAGGCTGGCGATAAGTACTACGCCGCTGATTA

TGACGAAGCTACAGGCGCCATTAAAGCTAAAACCACATCTTATACCGCTG

CCGATGGTACTACCAAGACTGCTGCCAATCAGCTGGGTGGAGTCGATGGA

AAAACCGAAGTGGTCACAATCGACGGAAAGACCTATCAAGCCTCCAAGGC

TGCTGGCCACGACTTCAAGGCCCAACCCGAACTGGCCGAGGCTGCTGCTA

AAACCACTGAAAACCCCCTGCAGAAAATTGACGCTGCCCTGGCCCAAGTG

GATGCCCTCCGCTCCGACCTCGGCGCTGTGCAAAACCGCTTCAACTCCGC

TATTACAAACCTCGGCAATACCGTCAATCAGCTCTCTGAAGCTAGGTCTC

GTATTGAGGATTCCGATTACGCTACCGAGGTCTCCCAGATGTCCCGTGCC

CAAATTCTCCAACAAGCCGGCACCTCCGTCCTCGCCCAAGCCAATCAGGT

GCCACAGAATGTGCTGAGCCTACTAGCATCAGGTTCCGGCTCAGGTTCCA

AAGGCATAGCGCCACTGCAGCTCGGCAAATGTAACATCGCAGGTTGGCTC

CTTGGTAACCCGGAGTGCGACCCCCTCCTCCCTGTACGATCCTGGAGTTA

TATCGTGGAGACCCCCAATAGCGAGAACGGAATTTGCTACCCAGGAGATT

TCATAGACTACGAGGAGTTGCGCGAGCAGCTTTCGTCTGTGAGCAGCTTC

GAGAGGTTCGAAATCTTCCCGAAGGAGAGCAGCTGGCCGAATCATAACAC

TAACGGTGTGACAGCCGCCTGCAGTCATGAAGGAAAGAGTTCATTCTATC

GCAACCTGCTGTGGTTGACGGAGAAAGAGGGCAGCTACCCTAAGTTGAAG

AACTCCTATGTGAACAAAAAAGGCAAGGAGGTTCTGGTGCTGTGGGGCAT

ACACCACCCCCCCAATAGCAAGGAGCAGCAGAATCTGTACCAAAACGAGA

ATGCCTATGTGAGCGTGGTCACTAGTAACTATAACCGTCGGTTCACTCCC

GAGATCGCCGAGCGTCCGAAGGTGAGGGACCAGGCAGGCCGGATGAACTA

CTACTGGACCCTATTGAAGCCAGGGGACACGATTATCTTCGAGGCAAACG

GAAACCTCATAGCGCCGATGTACGCGTTCGCCCTGAGCCGTGGCTTTGGA

TCGGGGATCATCACGTCTCACCATCATCACCACCATTAATAG

SEQ ID NO: 122 ng HA1-2
AAAGGCATAGCGCCACTGCAGCTCGGCAAATGTAACATCGCAGGTTGGCT

CCTTGGTAACCCGGAGTGCGACCCCCTCCTCCCTGTACGATCCTGGAGTT

ATATCGTGGAGACCCCCAATAGCGAGAACGGAATTTGCTACCCAGGAGAT

TTCATAGACTACGAGGAGTTGCGCGAGCAGCTTTCGTCTGTGAGCAGCTT

CGAAAGGTTCGAGATATTCCCGAAGGAGAGCAGCTGGCCGAATCATAACA

CTAACGGTGTGACAGCCGCCTGCAGTCATGAAGGAAAGAGTTCATTCTAT

CGCAACCTGCTGTGGTTGACGGAGAAAGAGGGCAGCTACCCTAAGTTGAA

GAACTCCTATGTGAACAAAAAAGGCAAGGAGGTTCTGGTGCTGTGGGGCA

TACACCACCCCCCCAATAGCAAGGAGCAGCAGAATCTGTACCAAAACGAG

AATGCCTATGTGAGCGTGGTCACTAGTAACTATAACCGTCGGTTCACTCC

CGAGATCGCCGAGCGTCCGAAGGTGAGGGACCAGGCAGGCCGGATGAACT

ACTACTGGACCCTATTGAAGCCAGGGGACACGATTATCTTCGAGGCAAAC

GGAAACCTCATAGCGCCGATGTACGCCTTCGCCCTGAGCCGTGGCTTTGG

ATCGGGGATCATCACGTCTCACCATCATCACCACCATTAATAG

SEQ ID NO: 123 ngSTF2.HA1-2mut
ATGAAATTCTTAGTCAACGTTGCCCTTGTTTTTATGGTCGTATACATTTC

TTACATCTATGCGGCCCAAGTGATCAACACCAACTCCCTGTCCCTGCTCA

CTCAAAACAACCTCCAGAAATCTCAGTCTGCTCTCGGTACTGCTATCGAG

CGTCTCTCCTCCGGCCTGAGGATCAACTCCGCTAAAGATGACGCCGCCGG

ACAAGCTATCGCTAACCGCTTTACTGCCAACATTAAAGGCCTGACCCAAG

CCTCTAGGAACGCCAATGATGGCATTTCTATCGCTCAAACCACCGAAGGC

GCCCTGAACGAAATCAATAATAACCTGCAACGTGTCCGCGAACTCGCCGT

CCAGTCCGCCCAATCTACCAACTCTCAGTCTGACCTGGACTCTATCCAAG

CTGAGATCACCCAAAGGCTCAACGAGATCGATCGTGTGTCTGGTCAAACT

CAGTTTAACGGCGTCAAAGTGCTGGCTCAAGACAACACACTCACCATCCA

AGTAGGAGCCAATGACGGCGAGACAATCGATATCGACCTGAAGCAGATCA

ATTCTCAAACTCTGGGCCTGGACTCCCTGAACGTCCAAAAGGCTTACGAC

GTGAAGGACACCGCTGTGACAACCAAAGCCTATGCTAATCAAGGAACAAC

CCTGGACGTGTCCGGACTCGATGACGCCGCTATCAAGGCCGCTACTGGCG

GCACTCAGGGAACTGCCTCTGTGACCGGAGGCGCTGTGAAGTTCGACGCC

GATAACAACAAATACTTCGTCACTATTGGTGGTTTCACTGGCGCTGACGC

CGCTAAGAACGGTGACTACGAGGTCAACGTCGCCACTGACGGAACAGTGA

CACTGGCCGCTGGCGCTACCAAGACCACAATGCCTGCTGGTGCTACTACT

AAGACAGAGGTGCAGGAACTCAAGGACACCCCTGCCGTGGTGTCCGCCGA

TGCTAAGAACGCTCTCATTGCTGGTGGTGTCGACGCTACGGACGCCAACG

GAGCCGAGCTTGTGAAAATGTCCTACACCGACAAGAACGGAAAGACTATC

GAGGGAGGTTACGCTCTGAAGGCTGGCGATAAGTACTACGCCGCTGATTA

TGACGAAGCTACAGGCGCCATTAAAGCTAAAACCACATCTTATACCGCTG

CCGATGGTACTACCAAGACTGCTGCCAATCAGCTGGGTGGAGTCGATGGA

AAAACCGAAGTGGTCACAATCGACGGAAAGACCTATCAAGCCTCCAAGGC

TGCTGGCCACGACTTCAAGGCCCAACCCGAACTGGCCGAGGCTGCTGCTA

AAACCACTGAAAACCCCCTGCAGAAAATTGACGCTGCCCTGGCCCAAGTG

GATGCCCTCCGCTCCGACCTCGGCGCTGTGCAAAACCGCTTCAACTCCGC

-continued

TATTACAAACCTCGGCAATACCGTCAATCAGCTCTCTGAAGCTAGGTCTC

GTATTGAGGATTCCGATTACGCTACCGAGGTCTCCCAGATGTCCCGTGCC

CAAATTCTCCAACAAGCCGGCACCTCCGTCCTCGCCCAAGCCAATCAGGT

GCCACAGAATGTGCTGAGCCTGCTGGCTTCTGGATCTGGATCTGGTTCTA

AAGGCGCTGCCCCTCTGCAACTCGGCAAGTGCAATATTGCGGGGTGGCTG

TTGGGCAACCCAGAATGTGACCCCCTCCTGCCCGTCCGTTCTTGGTCTGA

CATCGCTGAAACACCTAACTCCGAGAACGGCATCTGTTACCCGGGCGACT

TCATTGACTACGAGGAGCTCCGCGAACAGCTGTCTTCTGTCTCTTCTTTC

GAACGTTTCGAAATTTTCCCAAAGGAATCCTCCTGGCCAAACCATAACAC

CAACGGAGTGACCGCCGCCTGTAGCCATGAGGGCAAGTCTTCTTTCTACC

GTAATCTGCTGTGGCTGACTGAAAAAGAGGGTTCTTATCCCAAACTGAAG

AACTCTTATGTCAACAAGAAGGGCAAAGAGGTCCTGGTGCTGTGGGGTAT

CCACCACCCCCCCAACTCCAAGGAGCAGCAGAATCTGTACCAAAACGAAA

ATGCTTACGTGTCTGTCGTGACATCTAACTACAACCGGCGCTTCACGCCC

GAAATCGCCGAGCGTCCCAAAGTGCGCGATCAGGCCGGAAGGATGAACTA

CTACTGGACCCTGCTCAAACCCGGAGATACCATCATATTCGAAGCCAATG

GCAATCTCATCGCTCCCATGTATGCTTTCGCTCTCTCTCGCGGATTCGGT

TCCGGCATAATCACTAGCCACCACCACCACCACCACTAATAG

SEQ ID NO: 124 ngHA1-2mut
AAAGGCGCTGCCCCTCTGCAACTCGGCAAGTGCAATATTGCGGGGTGGCT

GTTGGGCAACCCAGAATGTGACCCCCTCCTGCCCGTCCGTTCTTGGTCTG

ACATCGCTGAAACACCTAACTCCGAGAACGGCATCTGTTACCCGGGCGAC

TTCATTGACTACGAGGAGCTCCGCGAACAGCTGTCTTCTGTCTCTTCTTT

CGAACGTTTCGAAATTTTCCCAAAGGAATCCTCCTGGCCAAACCATAACA

CCAACGGAGTGACCGCCGCCTGTAGCCATGAGGGCAAGTCTTCTTTCTAC

CGTAATCTGCTGTGGCTGACTGAAAAAGAGGGTTCTTATCCCAAACTGAA

GAACTCTTATGTCAACAAGAAGGGCAAAGAGGTCCTGGTGCTGTGGGGTA

TCCACCACCCCCCCAACTCCAAGGAGCAGCAGAATCTGTACCAAAACGAA

AATGCTTACGTGTCTGTCGTGACATCTAACTACAACCGGCGCTTCACGCC

CGAAATCGCCGAGCGTCCCAAAGTGCGCGATCAGGCCGGAAGGATGAACT

ACTACTGGACCCTGCTCAAACCCGGAGATACCATCATATTCGAAGCCAAT

GGCAATCTCATCGCTCCCATGTATGCTTTCGCTCTCTCTCGCGGATTCGG

TTCCGGCATAATCACTAGCCACCACCACCACCACCACTAATAG

SEQ ID NO: 125 ngSTF2.HA1-3
ATGAAATTCTTAGTCAACGTTGCCCTTGTTTTTATGGTCGTATACATTTC

TTACATCTATGCGGCCCAAGTGATCAACACCAACTCCCTGTCCCTGCTCA

CTCAAAACAACCTCCAGAAATCTCAGTCTGCTCTCGGTACTGCTATCGAG

CGTCTCTCCTCCGGCCTGAGGATCAACTCCGCTAAAGATGACGCCGCCGG

ACAAGCTATCGCTAACCGCTTTACTGCCAACATTAAAGGCCTGACCCAAG

CCTCTAGGAACGCCAATGATGGCATTTCTATCGCTCAAACCACCGAAGGC

GCCCTGAACGAAATCAATAATAACCTGCAACGTGTCCGCGAACTCGCCGT

-continued

CCAGTCCGCCCAATCTACCAACTCTCAGTCTGACCTGGACTCTATCCAAG

CTGAGATCACCCAAAGGCTCAACGAGATCGATCGTGTGTCTGGTCAAACT

CAGTTTAACGGCGTCAAAGTGCTGGCTCAAGACAACACACTCACCATCCA

AGTAGGAGCCAATGACGGCGAGACAATCGATATCGACCTGAAGCAGATCA

ATTCTCAAACTCTGGGCCTGGACTCCCTGAACGTCCAAAAGGCTTACGAC

GTGAAGGACACCGCTGTGACAACCAAAGCCTATGCTAATCAAGGAACAAC

CCTGGACGTGTCCGGACTCGATGACGCCGCTATCAAGGCCGCTACTGGCG

GCACTCAGGGAACTGCCTCTGTGACCGGAGGCGCTGTGAAGTTCGACGCC

GATAACAACAAATACTTCGTCACTATTGGTGGTTTCACTGGCGCTGACGC

CGCTAAGAACGGTGACTACGAGGTCAACGTCGCCACTGACGGAACAGTGA

CACTGGCCGCTGGCGCTACCAAGACCACAATGCCTGCTGGTGCTACTACT

AAGACAGAGGTGCAGGAACTCAAGGACACCCCTGCCGTGGTGTCCGCCGA

TGCTAAGAACGCTCTCATTGCTGGTGGTGTCGACGCTACGGACGCCAACG

GAGCCGAGCTTGTGAAAATGTCCTACACCGACAAGAACGGAAAGACTATC

GAGGGAGGTTACGCTCTGAAGGCTGGCGATAAGTACTACGCCGCTGATTA

TGACGAAGCTACAGGCGCCATTAAAGCTAAAACCACATCTTATACCGCTG

CCGATGGTACTACCAAGACTGCTGCCAATCAGCTGGGTGGAGTCGATGGA

AAAACCGAAGTGGTCACAATCGACGGAAAGACCTATCAAGCCTCCAAGGC

TGCTGGCCACGACTTCAAGGCCCAACCCGAACTGGCCGAGGCTGCTGCTA

AAACCACTGAAAACCCCCTGCAGAAAATTGACGCTGCCCTGGCCCAAGTG

GATGCCCTCCGCTCCGACCTCGGCGCTGTGCAAAACCGCTTCAACTCCGC

TATTACAAACCTCGGCAATACCGTCAATCAGCTCTCTGAAGCTAGGTCTC

GTATTGAGGATTCCGATTACGCTACCGAGGTCTCCCAGATGTCCCGTGCC

CAAATTCTCCAACAAGCCGGCACCTCCGTCCTCGCCCAAGCCAATCAGGT

GCCACAGAATGTGCTGAGCCTACTAGCATCAGGTTCCGGCTCAGGTTCCA

ATAGCGAGAACGGAATTTGCTACCCAGGAGATTTCATAGACTACGAGGAG

TTGCGCGAGCAGCTTTCGTCTGTGAGCAGCTTCGAGAGGTTCGAAATCTT

CCCGAAGGAGAGCAGCTGGCCGAATCATAACACTAACGGTGTGACAGCCG

CCTGCAGTCATGAAGGAAAGAGTTCATTCTATCGCAACCTGCTGTGGTTG

ACGGAGAAGGAGGGCAGCTACCCTAAGCTGAAGAACTCCTATGTGAACAA

AAAAGGCAAGGAGGTTCTGGTGCTGTGGGGCATACACCACCCCCCCAATA

GCAAGGAGCAGCAGAATCTGTACCAAAACGAGAATGCCTATGTGAGCGTG

GTCACTAGTAACTATAACCGTCGGTTCACTCCCGAGATCGCCGAGCGTCC

GAAGGTGAGGGACCAGGCAGGCCGGATGAACTACTACTGGACCCTATTGA

AGCCAGGGGACACGATTATCTTCGAGGCAAACGGAAACCTCATAGCGCCG

ATGTACGCCTTCGCCCTGAGCCGTGGCCACCATCATCACCACCATTAATA

G

SEQ ID NO: 126 ngHA1-3
AATAGCGAGAACGGAATTTGCTACCCAGGAGATTTCATAGACTACGAGGA

GTTGCGCGAGCAGCTTTCGTCTGTGAGCAGCTTCGAAAGGTTCGAGATAT

TCCCGAAGGAGAGCAGCTGGCCGAATCATAACACTAACGGTGTGACAGCC

-continued

GCCTGCAGTCATGAAGGAAAGAGTTCATTCTATCGCAACCTGCTGTGGTT

GACGGAGAAAGAGGGCAGCTACCCTAAGTTGAAGAACTCCTATGTGAACA

AAAAAGGCAAGGAGGTTCTGGTGCTGTGGGGCATACACCACCCCCCCAAT

AGCAAGGAGCAGCAGAATCTGTACCAAAACGAGAATGCCTATGTGAGCGT

GGTCACTAGTAACTATAACCGTCGGTTCACTCCCGAGATCGCCGAGCGTC

CGAAGGTGAGGGACCAGGCAGGCCGGATGAACTACTACTGGACCCTATTG

AAGCCAGGGGACACGATTATCTTCGAGGCAAACGGAAACCTCATAGCGCC

GATGTACGCCTTCGCCCTGAGCCGTGGCCACCATCATCACCACCATTAAT

AG

SEQ ID NO: 127 ngSTF2.HA1-3mut

ATGAAATTCTTAGTCAACGTTGCCCTTGTTTTTATGGTCGTATACATTTC

TTACATCTATGCGGCCCAAGTGATCAACACCAACTCCCTGTCCCTGCTCA

CTCAAAACAACCTCCAGAAATCTCAGTCTGCTCTCGGTACTGCTATCGAG

CGTCTCTCCTCCGGCCTGAGGATCAACTCCGCTAAAGATGACGCCGCCGG

ACAAGCTATCGCTAACCGCTTTACTGCCAACATTAAAGGCCTGACCCAAG

CCTCTAGGAACGCCAATGATGGCATTTCTATCGCTCAAACCACCGAAGGC

GCCCTGAACGAAATCAATAATAACCTGCAACGTGTCCGCGAACTCGCCGT

CCAGTCCGCCCAATCTACCAACTCTCAGTCTGACCTGGACTCTATCCAAG

CTGAGATCACCCAAAGGCTCAACGAGATCGATCGTGTGTCTGGTCAAACT

CAGTTTAACGGCGTCAAAGTGCTGGCTCAAGACAACACACTCACCATCCA

AGTAGGAGCCAATGACGGCGAGACAATCGATATCGACCTGAAGCAGATCA

ATTCTCAAACTCTGGGCCTGGACTCCCTGAACGTCCAAAAGGCTTACGAC

GTGAAGGACACCGCTGTGACAACCAAAGCCTATGCTAATCAAGGAACAAC

CCTGGACGTGTCCGGACTCGATGACGCCGCTATCAAGGCCGCTACTGGCG

GCACTCAGGGAACTGCCTCTGTGACCGGAGGCGCTGTGAAGTTCGACGCC

GATAACAACAAATACTTCGTCACTATTGGTGGTTTCACTGGCGCTGACGC

CGCTAAGAACGGTGACTACGAGGTCAACGTCGCCACTGACGGAACAGTGA

CACTGGCCGCTGGCGCTACCAAGACCACAATGCCTGCTGGTGCTACTACT

AAGACAGAGGTGCAGGAACTCAAGGACACCCCTGCCGTGGTGTCCGCCGA

TGCTAAGAACGCTCTCATTGCTGGTGGTGTCGACGCTACGGACGCCAACG

GAGCCGAGCTTGTGAAAATGTCCTACACCGACAAGAACGGAAAGACTATC

GAGGGAGGTTACGCTCTGAAGGCTGGCGATAAGTACTACGCCGCTGATTA

TGACGAAGCTACAGGCGCCATTAAAGCTAAAACCACATCTTATACCGCTG

CCGATGGTACTACCAAGACTGCTGCCAATCAGCTGGGTGGAGTCGATGGA

AAAACCGAAGTGGTCACAATCGACGGAAAGACCTATCAAGCCTCCAAGGC

TGCTGGCCACGACTTCAAGGCCCAACCCGAACTGGCCGAGGCTGCTGCTA

AAACCACTGAAAACCCCCTGCAGAAAATTGACGCTGCCCTGGCCCAAGTG

GATGCCCTCCGCTCCGACCTCGGCGCTGTGCAAAACCGCTTCAACTCCGC

TATTACAAACCTCGGCAATACCGTCAATCAGCTCTCTGAAGCTAGGTCTC

GTATTGAGGATTCCGATTACGCTACCGAGGTCTCCCAGATGTCCCGTGCC

CAAATTCTCCAACAAGCCGGCACCTCCGTCCTCGCCCAAGCCAATCAGGT

-continued

GCCACAGAATGTGCTGAGCCTGCTGGCTTCTGGATCTGGATCTGGTTCTA

ACTCCGAGAACGAAATCTGTTACCCGGGCGACTTCATTGACAAAGAGGAG

CTCCGCGAACAGCTGTCTTCTGTCTCTTCTTTCGAACGTTTCGAAATTTT

CCCAAAGGAATCCTCCTGGCCAAACCATAACACCAACGGAGTGACCGCCG

CCTGTAGCCATGAGGGCAAGTCTTCTTTCTACCGTAATCTGCTGTGGCTG

ACTGAAAAAGAGGGTTCTTATCCCAAACTGAAGAACTCTTATGTCAACAA

GAAGGGCAAAGAGGTCCTGGTGCTGTGGGGTATCCACCACCCCCCCAACT

CCAAGGAGCAGCAGAATCTGTACCAAAACGAAAATGCTTACGTGTCTGTC

GTGACATCTAACTACAACCGGCGCTTCACGCCCGAAATCGCCGAGCGTCC

CAAAGTGCGCGATCAGGCCGGAAGGATGAACTACTACTGGACCCTGCTCA

AACCCGGAGATACCATCATATTCGAAGCCAATGGCAATCTCATCGCTCCC

ATGTATGCTGCTGCTCTCTCTCGCGGACACCACCACCACCACCACTAATA

G

SEQ ID NO: 128 ngHA1-3mut

AACTCCGAGAACGAAATCTGTTACCCGGGCGACTTCATTGACAAAGAGGA

GCTCCGCGAACAGCTGTCTTCTGTCTCTTCTTTCGAACGTTTCGAAATTT

TCCCAAAGGAATCCTCCTGGCCAAACCATAACACCAACGGAGTGACCGCC

GCCTGTAGCCATGAGGGCAAGTCTTCTTTCTACCGTAATCTGCTGTGGCT

GACTGAAAAAGAGGGTTCTTATCCCAAACTGAAGAACTCTTATGTCAACA

AGAAGGGCAAAGAGGTCCTGGTGCTGTGGGGTATCCACCACCCCCCCAAC

TCCAAGGAGCAGCAGAATCTGTACCAAAACGAAAATGCTTACGTGTCTGT

CGTGACATCTAACTACAACCGGCGCTTCACGCCCGAAATCGCCGAGCGTC

CCAAAGTGCGCGATCAGGCCGGAAGGATGAACTACTACTGGACCCTGCTC

AAACCCGGAGATACCATCATATTCGAAGCCAATGGCAATCTCATCGCTCC

CATGTATGCTGCTGCTCTCTCTCGCGGACACCACCACCACCACCACTAAT

AG

SEQ ID NO: 129 wtSTF2.HA1-1ng

ATGAAATTCTTAGTCAACGTTGCCCTTGTTTTTATGGTCGTATACATTTC

TTACATCTATGCGGCCCAGGTTATCAATACCAACTCCCTGTCGTTGCTCA

CCCAAAATAACCTTAATAAAAGCCAGAGCGCACTGGGAACCGCCATAGAA

CGCCTCTCAAGCGGCCTCCGGATCAATTCTGCAAAAGACGACGCCGCCGG

TCAGGCCATCGCAAACCGCTTTACCGCCAATATCAAGGGACTGACGCAGG

CTTCGAGGAATGCTAACGATGGAATAAGCATCGCTCAAACCACGGAGGGC

GCCCTGAACGAGATCAACAACAACCTACAGCGCGTCAGGGAGCTCGCAGT

GCAGTCCGCCAATTCGACCAACTCGCAGTCGGACCTGGACTCGATCCAAG

CCGAAATCACCCAGCGCCTGAATGAGATTGACCGGGTGAGCGGTCAGACA

CAGTTTAACGGCGTGAAGGTACTTGCACAGGATAACACACTTACGATACA

GGTGGGCGCCAACGATGGTGAAACCATAGACATTGATCTCAAACAGATTA

ACAGCCAGACGCTCGGGTTGGATAGCCTGAATGTGCAAAAGGCGTACGAC

GTGAAAGACACGGCGGTCACTACCAAAGCCTACGCTAACAATGGCACTAC

CTTGGATGTGAGCGGATTGGATGATGCAGCAATCAAGGCTGCTACCGGCG

GTACGAACGGAACCGCGTCCGTGACCGGCGGTGCCGTGAAGTTCGATGCT

-continued

GACAACAATAAGTATTTCGTCACCATTGGAGGCTTTACTGGCGCCGACGC
AGCAAAGAACGGCGACTATGAAGTGAACGTGGCAACCGATGGAACCGTGA
CGCTGGCCGCTGGTGCCACCAAGACCACCATGCCAGCCGGCGCCACAACT
AAGACCGAGGTGCAGGAGTTAAAGGACACCCCCGCGGTGGTTAGCGCAGA
TGCCAAAAACGCCTTGATCGCCGGCGGAGTGGATGCAACTGATGCTAATG
GTGCGGAGCTGGTTAAAATGTCGTATACAGACAAGAATGGTAAGACGATC
GAGGGCGGTTATGCCCTTAAGGCAGGAGATAAGTATTACGCTGCTGATTA
CGATGAGGCGACGGGAGCTATTAAGGCCAAGACAACGTCATACACGGCGG
CGGACGGAACGACTAAGACGGCTGCCAATCAGTTGGGAGGGGTTGACGGG
AAGACAGAGGTCGTTACGATCGATGGCAAGACATACAACGCTTCCAAGGC
CGCTGGCCACGATTTCAAAGCTCAACCCGAACTGGCCGAGGCCGCGGCGA
AAACAACTGAGAACCCGTTGCAGAAGATTGATGCGGCCCTGGCGCAAGTA
GATGCCCTGCGCTCAGACCTGGGCGCCGTTCAAAATCGATTCAATTCCGC
GATTACAAACCTGGGCAATACAGTAAACAATCTATCCGAGGCCAGATCCC
GCATTGAAGACTCCGACTACGCGACAGAAGTAAGTAACATGAGTCGTGCC
CAGATTCTGCAGCAGGCCGGCACTAGTGTCCTGGCCCAGGCCAATCAAGT
CCCGCAGAATGTGCTGAGCCTACTAGCATCTGGATCTGGATCTGGTTCTT
CCCATAATGGCAAATTGTGTCGGCTGAAAGGCATCGCCCCTCTGCAACTC
GGCAAGTGCAATATTGCGGGGTGGCTGTTGGGCAACCCAGAATGTGACCC
CCTCCTGCCCGTCCGTTCTTGGTCTTACATCGTGGAAACACCTAACTCCG
AGAACGGCATCTGTTACCCGGGCGACTTCATTGACTACGAGGAGCTCCGC
GAACAGCTGTCTTCTGTCTCTTCTTTCGAACGTTTCGAAATTTTCCCAAA
GGAATCCTCCTGGCCAAACCATAACACCAACGGAGTGACCGCCGCCTGTA
GCCATGAGGGCAAGTCTTCTTTCTACCGTAATCTGCTGTGGCTGACTGAA
AAAGAGGGTTCTTATCCCAAACTGAAGAACTCTTATGTCAACAAGAAGGG
CAAAGAGGTCCTGGTGCTGTGGGGTATCCACCACCCCCCCAACTCCAAGG
AGCAGCAGAATCTGTACCAAAACGAAAATGCTTACGTGTCTGTCGTGACA
TCTAACTACAACCGGCGCTTCACGCCCGAAATCGCCGAGCGTCCCAAAGT
GCGCGATCAGGCCGGAAGGATGAACTACTACTGGACCCTGCTCAAACCCG
GAGATACCATCATATTCGAAGCCAATGGCAATCTCATCGCTCCCATGTAT
GCTTTCGCTCTCTCTCGCGGATTCGGTTCCGGCATAATCACTAGCCAAGC
CTCCATGCACGAGTGCAATACCAAGTGTCAAACTCCACTGGGAGCCATTC
AAAGCTCCCTGCCCTACCAAAACATCCATCCTGTGACCATTGGAGAGTGC
CCTAAATACGTGCGCCACCACCACCACCACCACTAATAG

SEQ ID NO: 130 ngHA1-1
TCCCATAATGGCAAATTGTGTCGGCTGAAAGGCATCGCCCCTCTGCAACT
CGGCAAGTGCAATATTGCGGGGTGGCTGTTGGGCAACCCAGAATGTGACC
CCCTCCTGCCCGTCCGTTCTTGGTCTTACATCGTGGAAACACCTAACTCC
GAGAACGGCATCTGTTACCCGGGCGACTTCATTGACTACGAGGAGCTCCG
CGAACAGCTGTCTTCTGTCTCTTCTTTCGAACGTTTCGAAATTTTCCCAA
AGGAATCCTCCTGGCCAAACCATAACACCAACGGAGTGACCGCCGCCTGT
AGCCATGAGGGCAAGTCTTCTTTCTACCGTAATCTGCTGTGGCTGACTGA
AAAAGAGGGTTCTTATCCCAAACTGAAGAACTCTTATGTCAACAAGAAGG
GCAAAGAGGTCCTGGTGCTGTGGGGTATCCACCACCCCCCCAACTCCAAG
GAGCAGCAGAATCTGTACCAAAACGAAAATGCTTACGTGTCTGTCGTGAC
ATCTAACTACAACCGGCGCTTCACGCCCGAAATCGCCGAGCGTCCCAAAG
TGCGCGATCAGGCCGGAAGGATGAACTACTACTGGACCCTGCTCAAACCC
GGAGATACCATCATATTCGAAGCCAATGGCAATCTCATCGCTCCCATGTA
TGCTTTCGCTCTCTCTCGCGGATTCGGTTCCGGCATAATCACTAGCCAAG
CCTCCATGCACGAGTGCAATACCAAGTGTCAAACTCCACTGGGAGCCATT
CAAAGCTCCCTGCCCTACCAAAACATCCATCCTGTGACCATTGGAGAGTG
CCCTAAATACGTGCGCCACCACCACCACCACCACTAATAG

SEQ ID NO: 131 ngSTF2.HA1-1wt
ATGAAATTCTTAGTCAACGTTGCCCTTGTTTTTATGGTCGTATACATTTC
TTACATCTATGCGGCCCAAGTGATCAACACCAACTCCCTGTCCCTGCTCA
CTCAAAACAACCTCCAGAAATCTCAGTCTGCTCTCGGTACTGCTATCGAG
CGTCTCTCCTCCGGCCTGAGGATCAACTCCGCTAAAGATGACGCCGCCGG
ACAAGCTATCGCTAACCGCTTTACTGCCAACATTAAAGGCCTGACCCAAG
CCTCTAGGAACGCCAATGATGGCATTTCTATCGCTCAAACCACCGAAGGC
GCCCTGAACGAAATCAATAATAACCTGCAACGTGTCCGCGAACTCGCCGT
CCAGTCCGCCCAATCTACCAACTCTCAGTCTGACCTGGACTCTATCCAAG
CTGAGATCACCCAAAGGCTCAACGAGATCGATCGTGTGTCTGGTCAAACT
CAGTTTAACGGCGTCAAAGTGCTGGCTCAAGACAACACACTCACCATCCA
AGTAGGAGCCAATGACGGCGAGACAATCGATATCGACCTGAAGCAGATCA
ATTCTCAAACTCTGGGCCTGGACTCCCTGAACGTCCAAAAGGCTTACGAC
GTGAAGGACACCGCTGTGACAACCAAAGCCTATGCTAATCAAGGAACAAC
CCTGGACGTGTCCGGACTCGATGACGCCGCTATCAAGGCCGCTACTGGCG
GCACTCAGGGAACTGCCTCTGTGACCGGAGGCGCTGTGAAGTTCGACGCC
GATAACAACAAATACTTCGTCACTATTGGTGGTTTCACTGGCGCTGACGC
CGCTAAGAACGGTGACTACGAGGTCAACGTCGCCACTGACGGAACAGTGA
CACTGGCCGCTGGCGCTACCAAGACCACAATGCCTGCTGGTGCTACTACT
AAGACAGAGGTGCAGGAACTCAAGGACACCCCTGCCGTGGTGTCCGCCGA
TGCTAAGAACGCTCTCATTGCTGGTGGTGTCGACGCTACGGACGCCAACG
GAGCCGAGCTTGTGAAAATGTCCTACACCGACAAGAACGGAAAGACTATC
GAGGGAGGTTACGCTCTGAAGGCTGGCGATAAGTACTACGCCGCTGATTA
TGACGAAGCTACAGGCGCCATTAAAGCTAAAACCACATCTTATACCGCTG
CCGATGGTACTACCAAGACTGCTGCCAATCAGCTGGGTGGAGTCGATGGA
AAAACCGAAGTGGTCACAATCGACGGAAAGACCTATCAAGCCTCCAAGGC
TGCTGGCCACGACTTCAAGGCCCAACCCGAACTGGCCGAGGCTGCTGCTA
AAACCACTGAAAACCCCCTGCAGAAAATTGACGCTGCCCTGGCCCAAGTG
GATGCCCTCCGCTCCGACCTCGGCGCTGTGCAAAACCGCTTCAACTCCGC
TATTACAAACCTCGGCAATACCGTCAATCAGCTCTCTGAAGCTAGGTCTC

-continued

GTATTGAGGATTCCGATTACGCTACCGAGGTCTCCCAGATGTCCCGTGCC
CAAATTCTCCAACAAGCCGGCACCTCCGTCCTCGCCCAAGCCAATCAGGT
GCCACAGAATGTGCTGAGCCTACTAGCATCAGGTTCCGGCTCAGGTTCCA
GCCACAACGGAAAGCTGTGCCGTCTGAAAGGCATAGCGCCACTGCAGCTC
GGCAAATGTAACATCGCAGGTTGGCTCCTTGGTAACCCGGAGTGCGACCC
CCTCCTCCCTGTACGATCCTGGAGTTATATCGTGGAGACCCCCAATAGCG
AGAACGGAATTTGCTACCCAGGAGATTTCATAGACTACGAGGAGTTGCGC
GAGCAGCTTTCGTCTGTGAGCAGCTTCGAGAGGTTCGAAATCTTCCCGAA
GGAGAGCAGCTGGCCGAATCATAACACTAACGGTGTGACAGCCGCCTGCA
GTCATGAAGGAAAGAGTTCATTCTATCGCAACCTGCTGTGGTTGACGGAG
AAAGAGGGCAGCTACCCTAAGTTGAAGAACTCCTATGTGAACAAAAAAGG
CAAGGAGGTTCTGGTGCTGTGGGGCATACACCACCCCCCCAATAGCAAGG
AGCAGCAGAATCTGTACCAAAACGAGAATGCCTATGTGAGCGTGGTCACT
AGTAACTATAACCGTCGGTTCACTCCCGAGATCGCCGAGCGTCCGAAGGT
GAGGGACCAGGCAGGCCGGATGAACTACTACTGGACCCTATTGAAGCCAG
GGGACACGATTATCTTCGAGGCAAACGGAAACCTCATAGCGCCGATGTAC
GCGTTCGCCCTGAGCCGCGGCTTTGGATCGGGGATCATCACGTCTAACGC
CTCGATGCACGAATGTAATACCAAATGCCAGACCCCACTGGGTGCTATCA
ACTCGTCCTTACCCTATCAAAATATACATCCGGTCACCATAGGCGAGTGT
CCCAAATATGTCAGACACCATCATCACCACCATTAATAG

SEQ ID NO: 132 HA1-1 PR8
AGCCACAACGGAAAGCTGTGCCGTCTGAAAGGCATAGCGCCACTGCAGCT
CGGCAAATGTAACATCGCAGGTTGGCTCCTTGGTAACCCGGAGTGCGACC
CCCTCCTCCCTGTACGATCCTGGAGTTATATCGTGGAGACCCCCAATAGC
GAGAACGGAATTTGCTACCCAGGAGATTTCATAGACTACGAGGAGTTGCG
CGAGCAGCTTTCGTCTGTGAGCAGCTTCGAAAGGTTCGAGATATTCCCGA
AGGAGAGCAGCTGGCCGAATCATAACACTAACGGTGTGACAGCCGCCTGC
AGTCATGAAGGAAAGAGTTCATTCTATCGCAACCTGCTGTGGTTGACGGA
GAAAGAGGGCAGCTACCCTAAGTTGAAGAACTCCTATGTGAACAAAAAAG
GCAAGGAGGTTCTGGTGCTGTGGGGCATACACCACCCCCCCAATAGCAAG
GAGCAGCAGAATCTGTACCAAAACGAGAATGCCTATGTGAGCGTGGTCAC
TAGTAACTATAACCGTCGGTTCACTCCCGAGATCGCCGAGCGTCCGAAGG
TGAGGGACCAGGCAGGCCGGATGAACTACTACTGGACCCTATTGAAGCCA
GGGGACACGATTATCTTCGAGGCAAACGGAAACCTCATAGCGCCGATGTA
CGCCTTCGCCCTGAGCCGTGGCTTTGGATCGGGGATCATCACGTCTAACG
CCTCGATGCACGAATGTAATACCAAATGCCAGACCCCACTGGGTGCTATC
AACTCGTCCTTACCCTATCAAAATATACATCCGGTCACCATAGGCGAGTG
TCCCAAATATGTCAGACACCATCATCACCACCATTAATAG

SEQ ID NO: 133 HA1-1 PR8
ATGAAATTCTTAGTCAACGTTGCCCTTGTTTTTATGGTCGTATACATTTC
TTACATCTATGCGAGCCACAACGGAAAGCTGTGCCGTCTGAAAGGCATAG

-continued

CGCCACTGCAGCTCGGCAAATGTAACATCGCAGGTTGGCTCCTTGGTAAC
CCGGAGTGCGACCCCCTCCTCCCTGTACGATCCTGGAGTTATATCGTGGA
GACCCCCAATAGCGAGAACGGAATTTGCTACCCAGGAGATTTCATAGACT
ACGAGGAGTTGCGCGAGCAGCTTTCGTCTGTGAGCAGCTTCGAAAGGTTC
GAGATATTCCCGAAGGAGAGCAGCTGGCCGAATCATAACACTAACGGTGT
GACAGCCGCCTGCAGTCATGAAGGAAAGAGTTCATTCTATCGCAACCTGC
TGTGGTTGACGGAGAAAGAGGGCAGCTACCCTAAGTTGAAGAACTCCTAT
GTGAACAAAAAAGGCAAGGAGGTTCTGGTGCTGTGGGGCATACACCACCC
CCCCAATAGCAAGGAGCAGCAGAATCTGTACCAAAACGAGAATGCCTATG
TGAGCGTGGTCACTAGTAACTATAACCGTCGGTTCACTCCCGAGATCGCC
GAGCGTCCGAAGGTGAGGGACCAGGCAGGCCGGATGAACTACTACTGGAC
CCTATTGAAGCCAGGGGACACGATTATCTTCGAGGCAAACGGAAACCTCA
TAGCGCCGATGTACGCCTTCGCCCTGAGCCGTGGCTTTGGATCGGGGATC
ATCACGTCTAACGCCTCGATGCACGAATGTAATACCAAATGCCAGACCCC
ACTGGGTGCTATCAACTCGTCCTTACCCTATCAAAATATACATCCGGTCA
CCATAGGCGAGTGTCCCAAATATGTCAGACACCATCATCACCACCATTAA
TAG

SEQ ID NO: 134 FOR PRIMER
AGGCAGATCTATGAAATTCTTAGTCAACGTTGCCCTTGTTTTTATGGTCG
TATACATTTCTTACATCTATGCGAGCCACAACGGAAAGCTGTGCCGTCTG
AAAGG

SEQ ID NO: 135 REV PRIMER
ACCTGCATGCCTATTAATGGTGGTGATGATGGTGTCTGACATATTTGGGA
CACTC

SEQ ID NO: 136 HA0s PR8
ATGAAATTCTTAGTCAACGTTGCCCTTGTTTTTATGGTCGTATACATTTC
TTACATCTATGCGGACACCATTTGCATTGGATACCATGCAAACAACTCAA
CCGATACTGTTGATACCGTCCTTGAGAAGAACGTTACCGTCACGCACTCG
GTCAACCTATTAGAGGATAGCCACAACGGAAAGCTGTGCCGTCTGAAAGG
CATAGCGCCACTGCAGCTCGGCAAATGTAACATCGCAGGTTGGCTCCTTG
GTAACCCGGAGTGCGACCCCCTCCTCCCTGTACGATCCTGGAGTTATATC
GTGGAGACCCCCAATAGCGAGAACGGAATTTGCTACCCAGGAGATTTCAT
AGACTACGAGGAGTTGCGCGAGCAGCTTTCGTCTGTGAGCAGCTTCGAAA
GGTTCGAGATATTCCCGAAGGAGAGCAGCTGGCCGAATCATAACACTAAC
GGTGTGACAGCCGCCTGCAGTCATGAAGGAAAGAGTTCATTCTATCGCAA
CCTGCTGTGGTTGACGGAGAAAGAGGGCAGCTACCCTAAGTTGAAGAACT
CCTATGTGAACAAAAAAGGCAAGGAGGTTCTGGTGCTGTGGGGCATACAC
CACCCCCCCAATAGCAAGGAGCAGCAGAATCTGTACCAAAACGAGAATGC
CTATGTGAGCGTGGTCACTAGTAACTATAACCGTCGGTTCACTCCCGAGA
TCGCCGAGCGTCCGAAGGTGAGGGACCAGGCAGGCCGGATGAACTACTAC
TGGACCCTATTGAAGCCAGGGGACACGATTATCTTCGAGGCAAACGGAAA
CCTCATAGCGCCGATGTACGCCTTCGCCCTGAGCCGTGGCTTTGGATCGG

-continued

GGATCATCACGTCTAACGCCTCGATGCACGAATGTAATACCAAATGCCAG

ACCCCACTGGGTGCTATCAACTCGTCCTTACCCTATCAAAATATACATCC

GGTCACCATAGGCGAGTGTCCCAAATATGTCAGATCCGCCAAGTTGCGGA

TGGTGACCGGCCTCCGCAATATTCCTAGTATTCAGTCACGCGGCTTGTTC

GGCGCCATCGCTGGTTTCATCGAAGGCGGGTGGACAGGCATGATTGATGG

CTGGTATGGCTATCACGACCAGAACGAGCAGGGCTCGGGCTACGCGGCTG

ACCAGAAGTCGACTCAGAATGCCATCAATGGCATCACGAATAAGGTGAAC

ACGGTCATTGAAAAGATGAACATTCAATTTACAGCCGTAGGAAAAGAGTT

TAATAAACTGGAAAAAAGAATGGAGAATCTGAATAAGAAGGTGGACGACG

GATTTTTGGACATCTGGACGTACAACGCCGAGCTGCTGGTTCTGCTGGAA

AATGAGCGAACACTGGATTTTCATGATTCTAACGTAAAGAATCTGTACGA

GAAGGTGAAGTCCCAACTAAAGAATAATGCCAAGGAAATCGGAAATGGAT

GCTTTGAGTTTTACCACAAGTGCGATAATGAGTGCATGGAATCCGTGCGA

AATGGTACATACGATTACCCAAAGTACTCCGAAGAATCCAAGCTAAATCG

CGAAAAGGTTGATGGTGTTAAACTTGAATCCATGGGTATTTACCAACACC

ATCATCACCACCATTAATAG

SEQ ID NO: 137 HA1-1 PR8 (no his tag)
ATGAAATTCTTAGTCAACGTTGCCCTTGTTTTTATGGTCGTATACATTTC

TTACATCTATGCGAGCCACAACGGAAAGCTGTGCCGTCTGAAAGGCATAG

CGCCACTGCAGCTCGGCAAATGTAACATCGCAGGTTGGCTCCTTGGTAAC

CCGGAGTGCGACCCCCTCCTCCCTGTACGATCCTGGAGTTATATCGTGGA

GACCCCCAATAGCGAGAACGGAATTTGCTACCCAGGAGATTTCATAGACT

ACGAGGAGTTGCGCGAGCAGCTTTCGTCTGTGAGCAGCTTCGAAAGGTTC

GAGATATTCCCGAAGGAGAGCAGCTGGCCGAATCATAACACTAACGGTGT

GACAGCCGCCTGCAGTCATGAAGGAAAGAGTTCATTCTATCGCAACCTGC

TGTGGTTGACGGAGAAAGAGGGCAGCTACCCTAAGTTGAAGAACTCCTAT

GTGAACAAAAAAGGCAAGGAGGTTCTGGTGCTGTGGGGCATACACCACCC

CCCCAATAGCAAGGAGCAGCAGAATCTGTACCAAAACGAGAATGCCTATG

TGAGCGTGGTCACTAGTAACTATAACCGTCGGTTCACTCCCGAGATCGCC

GAGCGTCCGAAGGTGAGGGACCAGGCAGGCCGGATGAACTACTACTGGAC

CCTATTGAAGCCAGGGGACACGATTATCTTCGAGGCAAACGGAAACCTCA

TAGCGCCGATGTACGCCTTCGCCCTGAGCCGTGGCTTTGGATCGGGGATC

ATCACGTCTAACGCCTCGATGCACGAATGTAATACCAAATGCCAGACCCC

ACTGGGTGCTATCAACTCGTCCTTACCCTATCAAAATATACATCCGGTCA

CCATAGGCGAGTGTCCCAAATATGTCAGATAATAG

SEQ ID NO: 138 REV PRIMER
ACCTGCATGCCTATTATCTGACATATTTGGGACACTCGCCTATGG

SEQ ID NO: 139 HA1-1 NC
ATGAAATTCTTAGTCAACGTTGCCCTTGTTTTTATGGTCGTATACATTTC

TTACATCTATGCGAGCCACAATGGTAAGCTGTGTCTGTTGAAGGGAATTG

CACCCCTCCAACTGGGCAACTGTTCGGTCGCTGGTTGGATCCTCGGAAAC

CCAGAATGCGAGCTCCTTATCAGTAAGGAATCTTGGTCTTATATTGTCGA

AACCCCGAACCCCGAGAACGGAACATGCTACCCGGGTTACTTTGCTGATT

ACGAAGAGCTTCGCGAGCAACTCAGCTCCGTATCCTCCTTCGAGCGCTTC

GAGATTTTTCCCAAAGAGTCCAGCTGGCCAAATCATACCGTCACCGGCGT

GTCGGCCTCCTGTTCCCACAACGGAAAGTCTAGCTTCTATAGAAATCTTC

TCTGGCTGACGGGTAAGAATGGTCTTTACCCCAATTTGAGCAAGTCCTAC

GTCAACAACAAAGAAAAGGAAGTTCTGGTATTGTGGGGTGTGCACCACCC

TCCGAACATCGGCAATCAGCGCGCCCTGTATCACACAGAGAACGCGTATG

TTTCCGTTGTCTCCTCACATTACTCGAGGCGCTTCACTCCTGAAATAGCT

AAGCGTCCGAAAGTGCGTGACCAGGAGGGACGTATCAACTATTATTGGAC

GCTGTTGGAGCCAGGCGATACAATTATCTTCGAGGCTAACGGTAACCTTA

TCGCTCCCTGGTACGCCTTCGCCCTGTCGCGTGGTTTCGGTAGTGGAATA

ATCACTAGTAATGCTCCTATGGACGAGTGTGACGCTAAGTGCCAAACACC

TCAGGGCGCTATCAATAGCTCCCTTCCATTCCAGAACGTCCATCCGGTTA

CCATTGGAGAGTGTCCAAAGTACGTGAGACACCATCATCACCATCACTAA

TAG

SEQ ID NO: 140 FOR PRIMER
AGGCAGATCTATGAAATTCTTAGTCAACGTTGCCCTTGTTTTTATGGTCG

TATACATTTCTTACATCTATGCGAGCCACAATGGTAAGCTGTGTCTGTTG

AAG

SEQ ID NO: 141 REV PRIMER
AGTCGCATGCCTATTAATGGTGGTGATGATGGTGTCTCACGTACTTTGGA

CACTCTCCAATGG

SEQ ID NO: 142 HA0s NC
AGATCTATGAAGTTTCTCGTGAACGTTGCACTGGTGTTTATGGTAGTCTA

TATATCGTACATTTATGCTGACACGATTTGCATCGGTTACCATGCGAACA

ACTCCACGGATACCGTGGACACAGTGTTGGAAAAGAACGTGACCGTCACG

CACTCCGTAAACCTTCTGGAGGACAGCCACAATGGTAAGCTGTGTCTGTT

GAAGGGAATTGCACCCCTCCAACTGGGCAACTGTTCGGTCGCTGGTTGGA

TCCTCGGAAACCCAGAATGCGAGCTCCTTATCAGTAAGGAATCTTGGTCT

TATATTGTCGAAACCCCGAACCCCGAGAACGGAACATGCTACCCGGGTTA

CTTTGCTGATTACGAAGAGCTTCGCGAGCAACTCAGCTCCGTATCCTCCT

TCGAGCGCTTCGAGATTTTTCCCAAAGAGTCCAGCTGGCCAAATCATACC

GTCACCGGCGTGTCGGCCTCCTGTTCCCACAACGGAAAGTCTAGCTTCTA

TAGAAATCTTCTCTGGCTGACGGGTAAGAATGGTCTTTACCCCAATTTGA

GCAAGTCCTACGTCAACAACAAAGAAAAGGAAGTTCTGGTATTGTGGGGT

GTGCACCACCCTCCGAACATCGGCAATCAGCGCGCCCTGTATCACACAGA

GAACGCGTATGTTTCCGTTGTCTCCTCACATTACTCGAGGCGCTTCACTC

CTGAAATAGCTAAGCGTCCGAAAGTGCGTGACCAGGAGGGACGTATCAAC

TATTATTGGACGCTGTTGGAGCCAGGCGATACAATTATCTTCGAGGCTAA

CGGTAACCTTATCGCTCCCTGGTACGCCTTCGCCCTGTCGCGTGGTTTCG

GTAGTGGAATAATCACTAGTAATGCTCCTATGGACGAGTGTGACGCTAAG

TGCCAAACACCTCAGGGCGCTATCAATAGCTCCCTTCCATTCCAGAACGT

CCATCCGGTTACCATTGGAGAGTGTCCAAAGTACGTGAGATCGGCCAAAC

TTCGCATGGTCACGGGTCTGCGCAACATCCCGTCAATCCAATCTAGGGGC

CTCTTCGGCGCTATCGCCGGTTTCATTGAGGGCGGTTGGACTGGAATGGT

TGACGGATGGTACGGCTATCATCACCAGAACGAACAAGGTTCCGGTTACG

CTGCTGACCAGAAATCTACTCAGAACGCGATCAATGGTATCACGAACAAG

GTGAACAGCGTCATTGAAAAGATGAATACTCAGTTTACAGCCGTGGGCAA

AGAGTTCAATAAACTCGAGAGACGTATGGAAAACCTCAATAAGAAGGTGG

ATGACGGCTTCCTGGACATTTGGACTTACAACGCCGAGCTGCTGGTCCTG

CTCGAGAACGAGAGAACCCTTGACTTCCACGACAGCAACGTCAAGAACCT

GTACGAGAAGGTGAAAAGTCAACTTAAAAACAATGCCAAGGAGATTGGTA

ACGGCTGCTTCGAATTCTACCACAAGTGTAATAATGAGTGCATGGAATCC

GTTAAGAACGGCACCTACGATTACCCTAAATACTCAGAGGAGTCCAAGCT

TAACCGCGAGAAGATCGACGGCGTAAAACTGGAAAGCATGGGCGTATACC

AACACCATCATCACCATCACTAATAGGCATGC

SEQ ID NO: 143 HA1-1 VN
ATGAAATTCTTAGTCAACGTTGCCCTTGTTTTTATGGTCGTATACATTTC

TTACATCTATGCGGAGAAGAAACACAACGGTAAGCTTTGCGACTTGGATG

GAGTCAAGCCCCTCATACTTAGAGATTGTAGTGTAGCCGGTTGGCTGCTC

GGTAACCCAATGTGCGATGAGTTCATCAATGTTCCCGAATGGTCATATAT

CGTCGAAAAAGCTAATCCTGTCAACGACCTGTGCTACCCCGGTGATTTCA

ATGACTATGAAGAACTGAAGCACCTGCTCTCCCGCATCAACCATTTCGAG

AAAATCCAGATCATTCCCAAGAGTTCCTGGTCTAGCCATGAGGCTAGTCT

GGGTGTCTCATCCGCCTGCCCATATCAGGGTAAAAGTTCTTTCTTTAGGA

ACGTAGTATGGTTGATAAAGAAAAACTCTACATACCCGACCATCAAGCGC

TCTTACAACAATACGAACCAAGAGGATCTGCTTGTCCTTTGGGGAATCCA

TCATCCTAATGATGCTGCCGAACAGACTAAGCTCTACCAAAACCCTACCA

CTTATATTTCCGTCGGCACCTCTACTCTGAACCAGCGCCTTGTGCCCAGG

ATCGCTACGAGATCAAAAGTCAACGGCCAATCGGGCCGCATGGAATTCTT

CTGGACGATCCTGAAGCCTAATGACGCTATCAACTTCGAGTCAAATGGAA

ACTTTATCGCTCCCGAGTACGCTTACAAGATCGTCAAGAAGGGCGACTCC

ACGATTATGAAGTCAGAGTTGGAGTACGGCAACTGCAACACAAAGTGCCA

AACTCCTATGGGCGCTATAAATTCTTCAATGCCGTTCCACAACATCCATC

CGCTCACGATCGGTGAGTGCCCGIAATATGTAAAGCACCATCACCACCAT

CACTAATAG

SEQ ID NO: 144 FOR PRIMER
AGGCAGATCTATGAAATTCTTAGTCAACGTTGCCCTTGTTTTTATGGTCG

TATACATTTCTTACATCTATGCGGAGAAGAAACACAACGGTAAGCTTTG

SEQ ID NO: 145 REV PRIMER
AGTCGCATGCCTATTATGGTGGTGATGATGGTGCTTTACATATTTCGGGC

ACTCACCG

SEQ ID NO: 146 HA0s VN
AGATCTATGAAATTCTTGGTTAATGTAGCCCTGGTGTTTATGGTAGTGTA

CATTTCATACATTTATGCTGATCAAATCTGCATTGGCTACCATGCCAACA

ACAGCACCGAGCAAGTTGACACGATCATGGAGAAGAACGTAACCGTCACT

CACGCTCAAGACATCCTGGAGAAGAAACACAACGGTAAGCTTTGCGACTT

GGATGGAGTCAAGCCCCTCATACTTAGAGATTGTAGTGTAGCCGGTTGGC

TGCTCGGTAACCCAATGTGCGATGAGTTCATCAATGTTCCCGAATGGTCA

TATATCGTCGAAAAAGCTAATCCTGTCAACGACCTGTGCTACCCCGGTGA

TTTCAATGACTATGAAGAACTGAAGCACCTGCTCTCCCGCATCAACCATT

TCGAGAAAATCCAGATCATTCCCAAGAGTTCCTGGTCTAGCCATGAGGCT

AGTCTGGGTGTCTCATCCGCCTGCCCATATCAGGGTAAAAGTTCTTTCTT

TAGGAACGTAGTATGGTTGATAAAGAAAAACTCTACATACCCGACCATCA

AGCGCTCTTACAACAATACGAACCAAGAGGATCTGCTTGTCCTTTGGGGA

ATCCATCATCCTAATGATGCTGCCGAACAGACTAAGCTCTACCAAAACCC

TACCACTTATATTTCCGTCGGCACCTCTACTCTGAACCAGCGCCTTGTGC

CCAGGATCGCTACGAGATCAAAAGTCAACGGCCAATCGGGCCGCATGGAA

TTCTTCTGGACGATCCTGAAGCCTAATGACGCTATCAACTTCGAGTCAAA

TGGAAACTTTATCGCTCCCGAGTACGCTTACAAGATCGTCAAGAAGGGCG

ACTCCACGATTATGAAGTCAGAGTTGGAGTACGGCAACTGCAACACAAAG

TGCCAAACTCCTATGGGCGCTATAAATTCTTCAATGCCGTTCCACAACAT

CCATCCGCTCACGATCGGTGAGTGCCCGAAATATGTAAAGTCGAATCGTC

TCGTACTGGCGACAGGCCTGAGAAATAGTCCGCAACGTGAACGTCGTCGC

AAGAAGAGAGGACTGTTTGGTGCCATTGCAGGCTTTATTGAGGGCGGCTG

GCAGGGCATGGTTGACGGATGGTACGGCTACCACCATTCAAACGAGCAGG

GATCTGGCTACGCCGCTGACAAAGAAAGCACCCAAAAGGCCATTGATGGA

GTGACGAATAAGGTGAATTCGATCATCGACAAAATGAACACGCAATTCGA

AGCAGTGGGTCGCGAATTCAATAACCTGGAGCGCCGTATCGAGAATCTGA

ACAAGAAGATGGAAGACGGCTTTTTGGATGTCTGGACATATAACGCTGAA

TTGCTGGTCCTCATGGAAAACGAGCGTACCCTTGATTTCCACGACAGCAA

CGTTAAGAACCTCTACGACAAGGTCAGGCTCCAGCTCAGGGATAACGCCA

AGGAATTGGGAAACGGATGCTTCGAGTTCTACCACAAATGCGACAACGAG

TGCATGGAGTCAGTCAGGAATGGTACCTACGACTACCCGCAATATTCTGA

GGAGGCTCGCTTGAAGCGTGAGGAAATATCGGGTGTTAAATTGGAGAGTA

TTGGAATCTACCAGCACCATCACCACCATCACTAATAGGCATGC

SEQ ID NO: 147 HA1-1 IND
ATGAAATTCTTAGTCAACGTTGCCCTTGTTTTTATGGTCGTATACATTTC

TTACATCTATGCGGAGAAAACCCATAACGGTAAGTTGTGCGACCTTGACG

GTGTAAAGCCCCTGATCCTCCGTGACTGCAGTGTTGCTGGTTGGCTTTTG

GGCAACCCCATGTGTGACGAATTTATCAACGTGCCTGAATGGTCATACAT

TGTAGAGAAGGCCAACCCCACGAACGATCTCTGTTATCCCGGCAGCTTCA

ATGACTATGAGGAACTTAAGCACCTTCTGTCACGTATCAACCACTTCGAA

AAGATCCAGATCATCCCGAAGAGCTCCTGGAGCGACCACGAAGCCAGTTC

GGGTGTGTCTTCCGCTTGCCCCTACCTCGGTAGCCCTTCCTTCTTCCGTA

ACGTAGTGTGGCTGATCAAGAAGAATAGCACTTACCCTACAATCAAAAAG

-continued

TCGTATAACAATACTAACCAAGAGGATCTGCTTGTACTCTGGGGAATTCA

TCATCCCAACGACGCGGCGGAGCAGACCAGGTTGTACCAGAACCCCACCA

CTTACATCTCCATCGGTACGTCCACACTGAATCAGCGTCTGGTCCCCAAG

ATCGCAACCAGGTCCAAGGTTAACGGTCAGTCCGGTCGTATGGAGTTCTT

CTGGACCATCCTGAAGCCCAACGACGCCATCAACTTCGAGTCCAACGGTA

ATTTCATTGCTCCGGAGTACGCCTACAAGATAGTTAAGAAGGGTGATTCA

GCGATCATGAAGTCGGAACTTGAGTATGGCAACTGCAACACTAAATGCCA

AACTCCAATGGGCGCTATCAACTCCAGTATGCCATTCCATAACATCCACC

CATTGACAATCGGTGAATGTCCCAAGTACGTGAAGCACCACCATCACCAT

CACTAATAG

SEQ ID NO: 148 FOR PRIMER
AGGCAGATCTATGAAATTCTTAGTCAACGTTGCCCTTGTTTTTATGGTCG

TATACATTTCTTACATCTATGCGGAGAAAACCCATAACGGTAAGTTGTG

SEQ ID NO: 149 REV PRIMER
AGTCGCATGCCTATTAATGGTGGTGATGATGGTGCTTCACGTACTTGGGA

CATTCACCGATTG

SEQ ID NO: 150 HA0s IND
AGATCTATGAAGTTCCTGGTCAATGTAGCCTTGGTATTTATGGTAGTCTA

TATCTCGTACATTTACGCAGACCAGATTTGTATTGGATATCACGCTAACA

ACAGCACAGAGCAGGTAGATACTATTATGGAGAAAAATGTTACCGTCACT

CACGCCCAGGACATCCTGGAGAAAACCCATAACGGTAAGTTGTGCGACCT

TGACGGTGTAAAGCCCCTGATCCTCCGTGACTGCAGTGTTGCTGGTTGGC

TTTTGGGCAACCCCATGTGTGACGAATTTATCAACGTGCCTGAATGGTCA

TACATTGTAGAGAAGGCCAACCCCACGAACGATCTCTGTTATCCCGGCAG

CTTCAATGACTATGAGGAACTTAAGCACCTTCTGTCACGTATCAACCACT

TCGAAAAGATCCAGATCATCCCGAAGAGCTCCTGGAGCGACCACGAAGCC

AGTTCGGGTGTGTCTTCCGCTTGCCCCTACCTCGGTAGCCCTTCCTTCTT

CCGTAACGTAGTGTGGCTGATCAAGAAGAATAGCACTTACCCTACAATCA

AAAAGTCGTATAACAATACTAACCAAGAGGATCTGCTTGTACTCTGGGGA

ATTCATCATCCCAACGACGCGGCGGAGCAGACCAGGTTGTACCAGAACCC

CACCACTTACATCTCCATCGGTACGTCCACACTGAATCAGCGTCTGGTCC

CCAAGATCGCAACCAGGTCCAAGGTTAACGGTCAGTCCGGTCGTATGGAG

TTCTTCTGGACCATCCTGAAGCCCAACGACGCCATCAACTTCGAGTCCAA

CGGTAATTTCATTGCTCCGGAGTACGCCTACAAGATAGTTAAGAAGGGTG

ATTCAGCGATCATGAAGTCGGAACTTGAGTATGGCAACTGCAACACTAAA

TGCCAAACTCCAATGGGCGCTATCAACTCCAGTATGCCATTCCATAACAT

CCACCCATTGACAATCGGTGAATGTCCCAAGTACGTGAAGAGCAACAGGT

TGGTATTGGCCACCGGTTTGAGAAACAGCCCCCAGAGAGAGTCGCGTCGT

AAAAAGCGCGGCTTGTTCGGAGCCATCGCTGGCTTCATAGAGGGTGGTTG

GCAGGGAATGGTCGATGGTTGGTATGGTTATCATCATTCCAACGAGCAGG

GAAGTGGTTACGCCGCCGACAAAGAATCGACCCAGAAGGCTATTGACGGC

GTCACAAACAAAGTAAACTCTATCATTGATAAGATGAACACCCAGTTCGA

-continued

GGCTGTAGGTAGAGAATTCAACAACCTCGAAAGACGTATTGAGAACCTGA

ACAAGAAAATGGAGGATGGCTTCCTGGACGTGTGGACCTACAATGCTGAG

CTGTTGGTCCTTATGGAGAACGAGCGTACCCTCGATTTCCATGACTCAAA

CGTGAAGAACCTGTATGACAAGGTGCGTTTGCAACTGAGGGACAACGCAA

AGGAGCTTGGAAACGGTTGTTTCGAATTTTATCATAAGTGCGACAATGAG

TGTATGGAGTCGATTAGAAATGGCACGTACAACTACCCTCAATACAGCGA

AGAAGCTCGTCTCAAACGTGAGGAAATCAGCGGCGTCAAGCTCGAATCAA

TCGGTACCTATCAGCACCACCATCACCATCACTAATAGGCATGC

SEQ ID NO: 151 STF2.HA1-1His (PR8)
MKFLVNVALVFMVVYISYIYAAQVINTNSLSLLTQNNLNKSQSALGTAIE

RLSSGLRINSAKDDAAGQAIANRFTANIKGLTQASRNANDGISIAQTTEG

ALNEINNNLQRVRELAVQSANSTNSQSDLDSIQAEITQRLNEIDRVSGQT

QFNGVKVLAQDNTLTIQVGANDGETIDIDLKQINSQTLGLDSLNVQKAYD

VKDTAVTTKAYANNGTTLDVSGLDDAAIKAATGGTNGTASVTGGAVKFDA

DNNKYFVTIGGFTGADAAKNGDYEVNVATDGTVTLAAGATKTTMPAGATT

KTEVQELKDTPAVVSADAKNALIAGGVDATDANGAELVKMSYTDKNGKTI

EGGYALKAGDKYYAADYDEATGAIKAKTTSYTAADGTTKTAANQLGGVDG

KTEVVTIDGKTYNASKAAGHDFKAQPELAEAAAKTTENPLQKIDAALAQV

DALRSDLGAVQNRFNSAITNLGNTVNNLSEARSRIEDSDYATEVSNMSRA

QILQQAGTSVLAQANQVPQNVLSLLASGSGSGSSHNGKLCRLKGIAPLQL

GKCNIAGWLLGNPECDPLLPVRSWSYIVETPNSENGICYPGDFIDYEELR

EQLSSVSSFERFEIFPKESSWPNHNTNGVTAACSHEGKSSFYRNLLWLTE

KEGSYPKLKNSYVNKKGKEVLVLWGIHHPPNSKEQQNLYQNENAYVSVVT

SNYNRRFTPEIAERPKVRDQAGRMNYYWTLLKPGDTIIFEANGNLIAPMY

AFALSRGFGSGIITSNASMHECNTKCQTPLGAINSSLPYQNIHPVTIGEC

PKYVRHHHHHH

SEQ ID NO: 152 ngSTF2.HA1-1His (PR8)
MKFLVNVALVFMVVYISYIYAAQVINTNSLSLLTQNNLQKSQSALGTAIE

RLSSGLRINSAKDDAAGQAIANRFTANIKGLTQASRNANDGISIAQTTEG

ALNEINNNLQRVRELAVQSAQSTNSQSDLDSIQAEITQRLNEIDRVSGQT

QFNGVKVLAQDNTLTIQVGANDGETIDIDLKQINSQTLGLDSLNVQKAYD

VKDTAVTTKAYANQGTTLDVSGLDDAAIKAATGGTQGTASVTGGAVKFDA

DNNKYFVTIGGFTGADAAKNGDYEVNVATDGTVTLAAGATKTTMPAGATT

KTEVQELKDTPAVVSADAKNALIAGGVDATDANGAELVKMSYTDKNGKTI

EGGYALKAGDKYYAADYDEATGAIKAKTTSYTAADGTTKTAANQLGGVDG

KTEVVTIDGKTYQASKAAGHDFKAQPELAEAAAKTTENPLQKIDAALAQV

DALRSDLGAVQNRFNSAITNLGNTVNQLSEARSRIEDSDYATEVSQMSRA

QILQQAGTSVLAQANQVPQNVLSLLASGSGSGSSHNGKLCRLKGIAPLQL

GKCNIAGWLLGNPECDPLLPVRSWSYIVETPNSENGICYPGDFIDYEELR

EQLSSVSSFERFEIFPKESSWPNHNTNGVTAACSHEGKSSFYRNLLWLTE

KEGSYPKLKNSYVNKKGKEVLVLWGIHHPPNSKEQQNLYQNENAYVSVVT

-continued

SNYNRRFTPEIAERPKVRDQAGRMNYYWTLLKPGDTIIFEANGNLIAPMY
AFALSRGFGSGIITSQASMHECNTKCQTPLGAIQSSLPYQNIHPVTIGEC
PKYVRHHHHHH

SEQ ID NO: 153 STF2.HA1-2His (PR8)
MKFLVNVALVFMVVYISYIYAAQVINTNSLSLLTQNNLNKSQSALGTAIE
RLSSGLRINSAKDDAAGQAIANRFTANIKGLTQASRNANDGISIAQTTEG
ALNEINNNLQRVRELAVQSANSTNSQSDLDSIQAEITQRLNEIDRVSGQT
QFNGVKVLAQDNTLTIQVGANDGETIDIDLKQINSQTLGLDSLNVQKAYD
VKDTAVTTKAYANNGTTLDVSGLDDAAIKAATGGTNGTASVTGGAVKFDA
DNNKYFVTIGGFTGADAAKNGDYEVNVATDGTVTLAAGATKTTMPAGATT
KTEVQELKDTPAVVSADAKNALIAGGVDATDANGAELVKMSYTDKNGKTI
EGGYALKAGDKYYAADYDEATGAIKAKTTSYTAADGTTKTAANQLGGVDG
KTEVVTIDGKTYNASKAAGHDFKAQPELAEAAAKTTENPLQKIDAALAQV
DALRSDLGAVQNRFNSAITNLGNTVNNLSEARSRIEDSDYATEVSNMSRA
QILQQAGTSVLAQANQVPQNVLSLLASGSGSGSKGIAPLQLGKCNIAGWLL
GNPECDPLLPVRSWSYIVETPNSENGICYPGDFIDYEELREQLSSVSSFE
RFEIFPKESSWPNHNTNGVTAACSHEGKSSFYRNLLWLTEKEGSYPKLKN
SYVNKKGKEVLVLWGIHHPPNSKEQQNLYQNENAYVSVVTSNYNRRFTPE
IAERPKVRDQAGRMNYYWTLLKPGDTIIFEANGNLIAPMYAFALSRGFGS
GIITSHHHHHH

SEQ ID NO: 154 ngSTF2.HA1-2His (PR8)
MKFLVNVALVFMVVYISYIYAAQVINTNSLSLLTQNNLQKSQSALGTAIE
RLSSGLRINSAKDDAAGQAIANRFTANIKGLTQASRNANDGISIAQTTEG
ALNEINNNLQRVRELAVQSAQSTNSQSDLDSIQAEITQRLNEIDRVSGQT
QFNGVKVLAQDNTLTIQVGANDGETIDIDLKQINSQTLGLDSLNVQKAYD
VKDTAVTTKAYANQGTTLDVSGLDDAAIKAATGGTQGTASVTGGAVKFDA
DNNKYFVTIGGFTGADAAKNGDYEVNVATDGTVTLAAGATKTTMPAGATT
KTEVQELKDTPAVVSADAKNALIAGGVDATDANGAELVKMSYTDKNGKTI
EGGYALKAGDKYYAADYDEATGAIKAKTTSYTAADGTTKTAANQLGGVDG
KTEVVTIDGKTYQASKAAGHDFKAQPELAEAAAKTTENPLQKIDAALAQV
DALRSDLGAVQNRFNSAITNLGNTVNQLSEARSRIEDSDYATEVSQMSRA
QILQQAGTSVLAQANQVPQNVLSLLASGSGSGSKGIAPLQLGKCNIAGWL
LGNPECDPLLPVRSWSYIVETPNSENGICYPGDFIDYEELREQLSSVSSE
ERFEIFPKESSWPNHNTNGVTAACSHEGKSSFYRNLLWLTEKEGSYPKLK
NSYVNKKGKEVLVLWGIHHPPNSKEQQNLYQNENAYVSVVTSNYNRRFTP
EIAERPKVRDQAGRMNYYWTLLKPGDTIIFEANGNLIAPMYAFALSRGFG
SGIITSHHHHHH

SEQ ID NO: 155 STF2.HA1-2mutHis (PR8)
MKFLVNVALVFMVVYISYIYAAQVINTNSLSLLTQNNLNKSQSALGTAIE
RLSSGLRINSAKDDAAGQAIANRFTANIKGLTQASRNANDGISIAQTTEG
ALNEINNNLQRVRELAVQSANSTNSQSDLDSIQAEITQRLNEIDRVSGQT
QFNGVKVLAQDNTLTIQVGANDGETIDIDLKQINSQTLGLDSLNVQKAYD
VKDTAVTTKAYANNGTTLDVSGLDDAAIKAATGGTNGTASVTGGAVKFDA
DNNKYFVTIGGFTGADAAKNGDYEVNVATDGTVTLAAGATKTTMPAGATT
KTEVQELKDTPAVVSADAKNALIAGGVDATDANGAELVKMSYTDKNGKTI
EGGYALKAGDKYYAADYDEATGAIKAKTTSYTAADGTTKTAANQLGGVDG
KTEVVTIDGKTYNASKAAGHDFKAQPELAEAAAKTTENPLQKIDAALAQV
DALRSDLGAVQNRFNSAITNLGNTVNNLSEARSRIEDSDYATEVSNMSRA
QILQQAGTSVLAQANQVPQNVLSLLASGSGSGSKGAAPLQLGKCNIAGWL
LGNPECDPLLPVRSWSDIAETPNSENGICYPGDFIDYEELREQLSSVSSF
ERFEIFPKESSWPNHNTNGVTAACSHEGKSSFYRNLLWLTEKEGSYPKLK
NSYVNKKGKEVLVLWGIHHPPNSKEQQNLYQNENAYVSVVTSNYNRRFTP
EIAERPKVRDQAGRMNYYWTLLKPGDTIIFEANGNLIAPMYAFALSRGFG
SGIITSHHHHHH SEQ ID NO: 156 ngSTF2.HA1-2mutHis (PR8)
MKFLVNVALVFMVVYISYIYAAQVINTNSLSLLTQNNLQKSQSALGTAIE
RLSSGLRINSAKDDAAGQAIANRFTANIKGLTQASRNANDGISIAQTTEG
ALNEINNNLQRVRELAVQSAQSTNSQSDLDSIQAEITQRLNEIDRVSGQT
QFNGVKVLAQDNTLTIQVGANDGETIDIDLKQINSQTLGLDSLNVQKAYD
VKDTAVTTKAYANQGTTLDVSGLDDAAIKAATGGTQGTASVTGGAVKFDA
DNNKYFVTIGGFTGADAAKNGDYEVNVATDGTVTLAAGATKTTMPAGATT
KTEVQELKDTPAVVSADAKNALIAGGVDATDANGAELVKMSYTDKNGKTI
EGGYALKAGDKYYAADYDEATGAIKAKTTSYTAADGTTKTAANQLGGVDG
KTEVVTIDGKTYQASKAAGHDFKAQPELAEAAAKTTENPLQKIDAALAQV
DALRSDLGAVQNRFNSAITNLGNTVNQLSEARSRIEDSDYATEVSQMSRA
QILQQAGTSVLAQANQVPQNVLSLLASGSGSGSKGAAPQLGKCNIAGWLL
GNPECDPLLPVRSWSDIAETPNSENGICYPGDFIDYEELREQLSSVSSFE
RFEIFPKESSWPNHNTNGVTAACSHEGKSSFYRNLLWLTEKEGSYPKLKN
SYVNKKGKEVLVLWGIHHPPNSKEQQNLYQNENAYVSVVTSNYNRRFTPE
IAERPKVRDQAGRMNYYWTLLKPGDTIIFEANGNLIAPMYAFALSRGFGS
GIITSHHHHHH SEQ ID NO: 157 STF2.HA1-3His (PR8)
MKFLVNVALVFMVVYISYIYAAQVINTNSLSLLTQNNLNKSQSALGTAIE
RLSSGLRINSAKDDAAGQAIANRFTANIKGLTQASRNANDGISIAQTTEG
ALNEINNNLQRVRELAVQSANSTNSQSDLDSIQAEITQRLNEIDRVSGQT
QFNGVKVLAQDNTLTIQVGANDGETIDIDLKQINSQTLGLDSLNVQKAYD
VKDTAVTTKAYANNGTTLDVSGLDDAAIKAATGGTNGTASVTGGAVKFDA
DNNKYFVTIGGFTGADAAKNGDYEVNVATDGTVTLAAGATKTTMPAGATT
KTEVQELKDTPAVVSADAKNALIAGGVDATDANGAELVKMSYTDKNGKTI
EGGYALKAGDKYYAADYDEATGAIKAKTTSYTAADGTTKTAANQLGGVDG
KTEVVTIDGKTYNASKAAGHDFKAQPELAEAAAKTTENPLQKIDAALAQV
DALRSDLGAVQNRFNSAITNLGNTVNNLSEARSRIEDSDYATEVSNMSRA
QILQQAGTSVLAQANQVPQNVLSLLASGSGSGSNSENGCYPGDFIDYEEL
REQLSSVSSFERFEIFPKESSWPNHNTNGVTAACSHEGKSSFYRNLLWLT -continued

EKEGSYPKLKNSYVNKKGKEVLVLWGIHHPPNSKEQQNLYQNENAYVSVV

TSNYNRRFTPEIAERPKVRDQAGRMNYYWTLLKPGDTIIFEANGNLIAPM

YAFALSRGHHHHHH

SEQ ID NO: 158 STF2.HA1-3mutHis (PR8)
MKFLVNVALVFMVVYISYIYAAQVINTNSLSLLTQNNLNKSQSALGTAIE

RLSSGLRINSAKDDAAGQAIANRFTANIKGLTQASRNANDGISIAQTTEG

ALNEINNNLQRVRELAVQSANSTNSQSDLDSIQAEITQRLNEIDRVSGQT

QFNGVKVLAQDNTLTIQVGANDGETIDIDLKQINSQTLGLDSLNVQKAYD

VKDTAVTTKAYANNGTTLDVSGLDDAAIKAATGGTNGTASVTGGAVKFDA

DNNKYFVTIGGFTGADAAKNGDYEVNVATDGTVTLAAGATKTTMPAGATT

KTEVQELKDTPAVVSADAKNALIAGGVDATDANGAELVKMSYTDKNGKTI

EGGYALKAGDKYYAADYDEATGAIKAKTTSYTAADGTTKTAANQLGGVDG

KTEVVTIDGKTYNASKAAGHDFKAQPELAEAAAKTTENPLQKIDAALAQV

DALRSDLGAVQNRFNSAITNLGNTVNNLSEARSRIEDSDYATEVSNMSRA

QILQQAGTSVLAQANQVPQNVLSLLASGSGSGSNSENEICYPGDFIDKEE

LREQLSSVSSFERFEIFPKESSWPNHNTNGVTAACSHEGKSSFYRNLLWL

TEKEGSYPKLKNSYVNKKGKEVLVLWGIHHPPNSKEQQNLYQNENAYVSV

VTSNYNRRFTPEIAERPKVRDQAGRMNYYWTLLKPGDTIIFEANGNLIAP

MYAAALSRGHHHHHH

SEQ ID NO: 159 STF2.HA1-2 (IND)
MAQVINTNSLSLLTQNNLNKSQSALGTAIERLSSGLRINSAKDDAAGQAI

ANRFTANIKGLTQASRNANDGISIAQTTEGALNEINNNLQRVRELAVQSA

NSTNSQSDLDSIQAEITQRLNEIDRVSGQTQFNGVKVLAQDNTLTIQVGA

NDGETIDIDLKQINSQTLGLDSLNVQKAYDVKDTAVTTKAYANNGTTLDV

SGLDDAAIKAATGGTNGTASVTGGAVKFDADNNKYFVTIGGFTGADAAKN

GDYEVNVATDGTVTLAAGATKTTMPAGATTKTEVQELKDTPAVVSADAKN

ALIAGGVDATDANGAELVKMSYTDKNGKTIEGGYALKAGDKYYAADYDEA

TGAIKAKTTSYTAADGTTKTAANQLGGVDGKTEVVTIDGKTYNASKAAGH

DFKAQPELAEAAAKTTENPLQKIDAALAQVDALRSDLGAVQNRFNSAITN

LGNTVNNLSEARSRIEDSDYATEVSNMSRAQILQQAGTSVLAQANQVPQN

VLSLLAGVKPLILRDCSVAGWLLGNPMCDEFINVPEWSYIVEKANPTNDL

CYPGSFNDYEELKHLLSRINHFEKIQIIPKSSWSDHEASSGVSSACPYLG

SPSFFRNVVWLIKKNSTYPTIKKSYNNTNQEDLLVLWGIHHPNDAAEQTR

LYQNPTTYISIGTSTLNQRLVPKIATRSKVNGQSGRMEFFWTILKPNDAI

NFESNGNFIAPEYAYKIVKKGDSAIMKSE

Drosophila
SEQ ID NO: 160 STF2Δ.HA0shis
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

-continued

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCATGGAGCGCCGGTGGATCCTGCTA

GCCCATGGACCGAAAACCCGCTGCAGAAAATTGATGCCGCGCTGGCGCAG

GTGGATGCGCTGCGCTCTGATCTGGGTGCGGTACAAAACCGTTTCAACTC

TGCTATCACCAACCTGGGCAATACCGTAAACAATCTGTCTGAAGCGCGTA

GCCGTATCGAAGATTCCGACTACGCGACCGAAGTTTCCAACATGTCTCGC

GCGCAGATTTTGCAGCAGGCCGGTACTTCCGTTCTGGCGCAGGCTAACCA

GGTCCCGCAGAACGTGCTGTCTCTGTTACGTGAATTCTCTAGATATCCAG

CACAGTGGCGGCCGCTCGACACAATATGTATAGGCTACCATGCGAACAAT

TCAACCGACACTGTTGACACAGTACTCGAGAAGAATGTGACAGTGACACA

CTCTGTTAACCTGCTCGAAGACAGCCACAACGGAAAACTATGTAGATTAA

AAGGAATAGCCCCACTACAATTGGGGAAATGTAACATCGCCGGATGGCTT

TTGGGAAACCCAGAATGCGACCCACTGCTTCCAGTGAGATCATGGTCCTA

CATTGTAGAAACACCAAACTCTGAGAATGGAATATGTTATCCAGGAGATT

TCATCGACTATGAGGAGCTGAGGGAGCAATTGAGCTCAGTGTCATCATTC

GAAAGATTCGAAATATTTCCCAAAGAAAGCTCATGGCCCAACCACAACAC

AAACGGAGTAACGGCAGCATGCTCCCATGAGGGGAAAAGCAGTTTTTACA

GAAATTTGCTATGGCTGACGGAGAAGGAGGGCTCATACCCAAAGCTGAAA

AATTCTTATGTGAACAAAAAAGGGAAAGAAGTCCTTGTACTGTGGGGTAT

TCATCACCCGCCTAACAGTAAGGAACAACAGAATCTCTATCAGAATGAAA

ATGCTTATGTCTCTGTAGTGACTTCAAATTATAACAGGAGATTTACCCCG

GAAATAGCAGAAAGACCCAAAGTAAGAGATCAAGCTGGGAGGATGAACTA

TTACTGGACCTTGCTAAAACCCGGAGACACAATAATATTTGAGGCAAATG

GAAATCTAATAGCACCAATGTATGCTTTCGCACTGAGTAGAGGCTTTGGG

TCCGGCATCATCACCTCAAACGCATCAATGCATGAGTGTAACACGAAGTG

TCAAACACCCCTGGGAGCTATAAACAGCAGTCTCCCTTACCAGAATATAC

ACCCAGTCACAATAGGAGAGTGCCCAAAATACGTCAGGAGTGCCAAATTG

AGGATGGTTACAGGACTAAGGAACATTCCGTCCATTCAATCCAGAGGTCT

ATTTGGAGCCATTGCCGGTTTTATTGAAGGGGGATGGACTGGAATGATAG

ATGGATGGTATGGTTATCATCATCAGAATGAACAGGGATCAGGCTATGCA

GCGGATCAAAAAAGCACACAAAATGCCATTAACGGGATTACAAACAAGGT

GAACACTGTTATCGAGAAAATGAACATTCAATTCACAGCTGTGGGTAAAG

AATTCAACAAATTAGAAAAAAGGATGGAAAATTTAAATAAAAAAGTTGAT

GATGGATTTCTGGACATTTGGACATATAATGCAGAATTGTTAGTTCTACT

GGAAAATGAAAGGACTCTGGATTTCCATGACTCAAATGTGAAGAATCTGT

ATGAGAAAGTAAAAAGCCAATTAAAGAATAATGCCAAAGAAATCGGAAAT

GGATGTTTTGAGTTCTACCACAAGTGTGACAATGAATGCATGGAAAGTGT

AAGAAATGGGACTTATGATTATCCCAAATATTCAGAAGAGTCAAAGTTGA
ACAGGGAAAAGGTAGATGGAGTGAAATTGGAATCAATGGGGATCTATCAG
ACGCGTACCGGTCATCATCACCATCACCATTGA

SEQ ID NO: 161 FOR PRIMER
ATTCTCCGGCGGCCGCTCGACACAATATGTATAGGCTACC

SEQ ID NO: 162 REV PRIMER
AGTCTTGCGGCCGCCTATTAATGGTGATGGTGATGATGCTGATAGATCCC
CATTGATTCC

SEQ ID NO: 163 HA0s PR8 template
GACACAATATGTATAGGCTACCATGCGAACAATTCAACCGACACTGTTGA
CACAGTACTCGAGAAGAATGTGACAGTGACACACTCTGTTAACCTGCTCG
AAGACAGCCACAACGGAAAACTATGTAGATTAAAAGGAATAGCCCCACTA
CAATTGGGGAAATGTAACATCGCCGGATGGCTTTTGGGAAACCCAGAATG
CGACCCACTGCTTCCAGTGAGATCATGGTCCTACATTGTAGAAACACCAA
ACTCTGAGAATGGAATATGTTATCCAGGAGATTTCATCGACTATGAGGAG
CTGAGGGAGCAATTGAGCTCAGTGTCATCATTCGAAAGATTCGAAATATT
TCCCAAAGAAAGCTCATGGCCCAACCACAACACAAACGGAGTAACGGCAG
CATGCTCCCATGAGGGGAAAAGCAGTTTTTACAGAAATTTGCTATGGCTG
ACGGAGAAGGAGGGCTCATACCCAAAGCTGAAAAATTCTTATGTGAACAA
AAAAGGGAAAGAAGTCCTTGTACTGTGGGGTATTCATCACCCGCCTAACA
GTAAGGAACAACAGAATCTCTATCAGAATGAAAATGCTTATGTCTCTGTA
GTGACTTCAAATTATAACAGGAGATTTACCCCGGAAATAGCAGAAAGACC
CAAAGTAAGAGATCAAGCTGGGAGGATGAACTATTACTGGACCTTGCTAA
AACCCGGAGACACAATAATATTTGAGGCAAATGGAAATCTAATAGCACCA
ATGTATGCTTTCGCACTGAGTAGAGGCTTTGGGTCCGGCATCATCACCTC
AAACGCATCAATGCATGAGTGTAACACGAAGTGTCAAACACCCCTGGGAG
CTATAAACAGCAGTCTCCCTTACCAGAATATACACCCAGTCACAATAGGA
GAGTGCCCAAAATACGTCAGGAGTGCCAAATTGAGGATGGTTACAGGACT
AAGGAACATTCCGTCCATTCAATCCAGAGGTCTATTTGGAGCCATTGCCG
GTTTTATTGAAGGGGGATGGACTGGAATGATAGATGGATGGTATGGTTAT
CATCATCAGAATGAACAGGGATCAGGCTATGCAGCGGATCAAAAAAGCAC
ACAAAATGCCATTAACGGGATTACAAACAAGGTGAACACTGTTATCGAGA
AAATGAACATTCAATTCACAGCTGTGGGTAAAGAATTCAACAAATTAGAA
AAAAGGATGGAAAATTTAAATAAAAAAGTTGATGATGGATTTCTGGACAT
TTGGACATATAATGCAGAATTGTTAGTTCTACTGGAAAATGAAAGGACTC
TGGATTTCCATGACTCAAATGTGAAGAATCTGTATGAGAAAGTAAAAAGC
CAATTAAAGAATAATGCCAAAGAAATCGGAAATGGATGTTTTGAGTTCTA
CCACAAGTGTGACAATGAATGCATGGAAAGTGTAAGAAATGGGACTTATG
ATTATCCCAAATATTCAGAAGAGTCAAAGTTGAACAGGGAAAAGGTAGAT
GGAGTGAAATTGGAATCAATGGGGATCTATCAG SEQ ID NO: 164 STF2Δ.HA0s
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCATGGAGCGCCGGTGGATCCTGCTA
GCCCATGGACCGAAAACCCGCTGCAGAAAATTGATGCCGCGCTGGCGCAG
GTGGATGCGCTGCGCTCTGATCTGGGTGCGGTACAAAACCGTTTCAACTC
TGCTATCACCAACCTGGGCAATACCGTAAACAATCTGTCTGAAGCGCGTA
GCCGTATCGAAGATTCCGACTACGCGACCGAAGTTTCCAACATGTCTCGC
GCGCAGATTTTGCAGCAGGCCGGTACTTCCGTTCTGGCGCAGGCTAACCA
GGTCCCGCAGAACGTGCTGTCTCTGTTACGTGAATTCTCTAGATATCCAG
CACAGTGGCGGCCGCTCGACACAATATGTATAGGCTACCATGCGAACAAT
TCAACCGACACTGTTGACACAGTACTCGAGAAGAATGTGACAGTGACACA
CTCTGTTAACCTGCTCGAAGACAGCCACAACGGAAAACTATGTAGATTAA
AAGGAATAGCCCCACTACAATTGGGGAAATGTAACATCGCCGGATGGCTT
TTGGGAAACCCAGAATGCGACCCACTGCTTCCAGTGAGATCATGGTCCTA
CATTGTAGAAACACCAAACTCTGAGAATGGAATATGTTATCCAGGAGATT
TCATCGACTATGAGGAGCTGAGGGAGCAATTGAGCTCAGTGTCATCATTC
GAAAGATTCGAAATATTTCCCAAAGAAAGCTCATGGCCCAACCACAACAC
AAACGGAGTAACGGCAGCATGCTCCCATGAGGGGAAAAGCAGTTTTTACA
GAAATTTGCTATGGCTGACGGAGAAGGAGGGCTCATACCCAAAGCTGAAA
AATTCTTATGTGAACAAAAAAGGGAAAGAAGTCCTTGTACTGTGGGGTAT
TCATCACCCGCCTAACAGTAAGGAACAACAGAATCTCTATCAGAATGAAA
ATGCTTATGTCTCTGTAGTGACTTCAAATTATAACAGGAGATTTACCCCG
GAAATAGCAGAAAGACCCAAAGTAAGAGATCAAGCTGGGAGGATGAACTA
TTACTGGACCTTGCTAAAACCCGGAGACACAATAATATTTGAGGCAAATG
GAAATCTAATAGCACCAATGTATGCTTTCGCACTGAGTAGAGGCTTTGGG
TCCGGCATCATCACCTCAAACGCATCAATGCATGAGTGTAACACGAAGTG
TCAAACACCCCTGGGAGCTATAAACAGCAGTCTCCCTTACCAGAATATAC
ACCCAGTCACAATAGGAGAGTGCCCAAAATACGTCAGGAGTGCCAAATTG
AGGATGGTTACAGGACTAAGGAACATTCCGTCCATTCAATCCAGAGGTCT
ATTTGGAGCCATTGCCGGTTTTATTGAAGGGGGATGGACTGGAATGATAG
ATGGATGGTATGGTTATCATCATCAGAATGAACAGGGATCAGGCTATGCA
GCGGATCAAAAAAGCACACAAAATGCCATTAACGGGATTACAAACAAGGT -continued

GAACACTGTTATCGAGAAAATGAACATTCAATTCACAGCTGTGGGTAAAG

AATTCAACAAATTAGAAAAAAGGATGGAAAATTTAAATAAAAAAGTTGAT

GATGGATTTCTGGACATTTGGACATATAATGCAGAATTGTTAGTTCTACT

GGAAAATGAAAGGACTCTGGATTTCCATGACTCAAATGTGAAGAATCTGT

ATGAGAAAGTAAAAAGCCAATTAAAGAATAATGCCAAAGAAATCGGAAAT

GGATGTTTTGAGTTCTACCACAAGTGTGACAATGAATGCATGGAAAGTGT

AAGAAATGGGACTTATGATTATCCCAAATATTCAGAAGAGTCAAAGTTGA

ACAGGGAAAAGGTAGATGGAGTGAAATTGGAATCAATGGGGATCTATCAG

TAG

SEQ ID NO: 165 FOR PRIMER
ATTCTCCGGCGGCCGCTCGACACAATATGTATAGGCTACC

SEQ ID NO: 166 REV PRIMER
AGTCTTGCGGCCGCCTATTAATGGTGATGGTGATGATGCTGATAGATCCC

CATTGATTCC

SEQ ID NO: 167 HA0s.STF2Δ
GACACAATATGTATAGGCTACCATGCGAACAATTCAACCGACACTGTTGA

CACAGTACTCGAGAAGAATGTGACAGTGACACACTCTGTTAACCTGCTCG

AAGACAGCCACAACGGAAAACTATGTAGATTAAAAGGAATAGCCCCACTA

CAATTGGGGAAATGTAACATCGCCGGATGGCTTTTGGGAAACCCAGAATG

CGACCCACTGCTTCCAGTGAGATCATGGTCCTACATTGTAGAAACACCAA

ACTCTGAGAATGGAATATGTTATCCAGGAGATTTCATCGACTATGAGGAG

CTGAGGGAGCAATTGAGCTCAGTGTCATCATTCGAAAGATTCGAAATATT

TCCCAAAGAAAGCTCATGGCCCAACCACAACACAAACGGAGTAACGGCAG

CATGCTCCCATGAGGGGAAAAGCAGTTTTTACAGAAATTTGCTATGGCTG

ACGGAGAAGGAGGGCTCATACCCAAAGCTGAAAAATTCTTATGTGAACAA

AAAAGGGAAAGAAGTCCTTGTACTGTGGGGTATTCATCACCCGCCTAACA

CTAAGGAACAACAGAATCTCTATCAGAATGAAAATGCTTATGTCTCTGTA

GTGACTTCAAATTATAACAGGAGATTTACCCCGGAAATAGCAGAAAGACC

CAAAGTAAGAGATCAAGCTGGGAGGATGAACTATTACTGGACCTTGCTAA

AACCCGGAGACACAATAATATTTGAGGCAAATGGAAATCTAATAGCACCA

ATGTATGCTTTCGCACTGAGTAGAGGCTTTGGGTCCGGCATCATCACCTC

AAACGCATCAATGCATGAGTGTAACACGAAGTGTCAAACACCCCTGGGAG

CTATAAACAGCAGTCTCCCTTACCAGAATATACACCCAGTCACAATAGGA

GAGTGCCCAAAATACGTCAGGAGTGCCAAGTTGAGGATGGTTACAGGACT

AAGGAACATTCCGTCCATTCAATCCAGAGGTCTATTTGGAGCCATTGCCG

GTTTTATTGAAGGGGGATGGACTGGAATGATAGATGGATGGTATGGTTAT

CATCATCAGAATGAACAGGGATCAGGCTATGCAGCGGATCAAAAAAGCAC

ACAAAATGCCATTAACGGGATTACAAACAAGGTGAACACTGTTATCGAGA

AAATGAACATTCAATTCACAGCTGTGGGTAAAGAATTCAACAAATTAGAA

AAAAGGATGGAAAATTTAAATAAAAAAGTTGATGATGGATTTCTGGACAT

TTGGACATATAATGCAGAATTGTTAGTTCTACTGGAAAATGAAAGGACTC

TGGATTTCCATGACTCAAATGTGAAGAATCTGTATGAGAAAGTAAAAAGC

-continued

CAATTAAAGAATAATGCCAAAGAAATCGGAAATGGATGTTTTGAGTTCTA

CCACAAGTGTGACAATGAATGCATGGAAAGTGTAAGAAATGGGACTTATG

ATTATCCCAAATATTCAGAAGAGTCAAAGTTGAACAGGGAAAAGGTAGAT

GGAGTGAAATTGGAATCAATGGGGATCTATCAGGAATTCTCTAGATATCC

AGCACAGTGGCGGCCGCTCGCACAAGTAATCAACACTAACAGTCTGTCGC

TGCTGACCCAGAATAACCTGAACAAATCCCAGTCCGCACTGGGCACCGCT

ATCGAGCGTCTGTCTTCTGGTCTGCGTATCAACAGCGCGAAAGACGATGC

GGCAGGTCAGGCGATTGCTAACCGTTTCACCGCGAACATCAAAGGTCTGA

CTCAGGCTTCCCGTAACGCTAACGACGGTATCTCCATTGCGCAGACCACT

GAAGGCGCGCTGAACGAAATCAACAACAACCTGCAGCGTGTGCGTGAACT

GGCGGTTCAGTCTGCTAACAGCACCAACTCCCAGTCTGACCTCGACTCCA

TCCAGGCTGAAATCACCCAGCGCCTGAACGAAATCGACCGTGTATCCGGC

CAGACTCAGTTCAACGGCGTGAAAGTCCTGGCGCAGGACAACACCCTGAC

CATCCAGGTTGGCGCCAACGACGGTGAAACTATCGATATCGATCTGAAGC

AGATCAACTCTCAGACCCTGGGTCTGGACTCACTGAACGTGCATGGAGCG

CCGGTGGATCCTGCTAGCCCATGGACCGAAAACCCGCTGCAGAAAATTGA

TGCCGCGCTGGCGCAGGTGGATGCGCTGCGCTCTGATCTGGGTGCGGTAC

AAAACCGTTTCAACTCTGCTATCACCAACCTGGGCAATACCGTAAACAAT

CTGTCTGAAGCGCGTAGCCGTATCGAAGATTCCGACTACGCGACCGAAGT

TTCCAACATGTCTCGCGCGCAGATTTTGCAGCAGGCCGGTACTTCCGTTC

TGGCGCAGGCTAACCAGGTCCCGCAGAACGTGCTGTCTCTGTTACGTTAA

TAG

SEQ ID NO: 168 FOR PRIMER
AGGCAAGATCTGACACAATATGTATAGGCTACC

SEQ ID NO: 169 REV PRIMER
AGTCAGACGCGTCTATTAACGTAACAGAGACAGCAC

SEQ ID NO: 170 Ha0s.his
GACACAATATGTATAGGCTACCATGCGAACAATTCAACCGACACTGTTGA

CACAGTACTCGAGAAGAATGTGACAGTGACACACTCTGTTAACCTGCTCG

AAGACAGCCACAACGGAAAACTATGTAGATTAAAAGGAATAGCCCCACTA

CAATTGGGGAAATGTAACATCGCCGGATGGCTTTTGGGAAACCCAGAATG

CGACCCACTGCTTCCAGTGAGATCATGGTCCTACATTGTAGAAACACCAA

ACTCTGAGAATGGAATATGTTATCCAGGAGATTTCATCGACTATGAGGAG

CTGAGGGAGCAATTGAGCTCAGTGTCATCATTCGAAAGATTCGAAATATT

TCCCAAAGAAAGCTCATGGCCCAACCACAACACAAACGGAGTAACGGCAG

CATGCTCCCATGAGGGGAAAAGCAGTTTTTACAGAAATTTGCTATGGCTG

ACGGAGAAGGAGGGCTCATACCCAAAGCTGAAAAATTCTTATGTGAACAA

AAAAGGGAAAGAAGTCCTTGTACTGTGGGGTATTCATCACCCGCCTAACA

GTAAGGAACAACAGAATCTCTATCAGAATGAAAATGCTTATGTCTCTGTA

GTGACTTCAAATTATAACAGGAGATTTACCCCGGAAATAGCAGAAAGACC

CAAAGTAAGAGATCAAGCTGGGAGGATGAACTATTACTGGACCTTGCTAA

AACCCGGAGACACAATAATATTTGAGGCAAATGGAAATCTAATAGCACCA

-continued

ATGTATGCTTTCGCACTGAGTAGAGGCTTTGGGTCCGGCATCATCACCTC
AAACGCATCAATGCATGAGTGTAACACGAAGTGTCAAACACCCCTGGGAG
CTATAAACAGCAGTCTCCCTTACCAGAATATACACCCAGTCACAATAGGA
GAGTGCCCAAAATACGTCAGGAGTGCCAAATTGAGGATGGTTACAGGACT
AAGGAACATTCCGTCCATTCAATCCAGAGGTCTATTTGGAGCCATTGCCG
GTTTTATTGAAGGGGGATGGACTGGAATGATAGATGGATGGTATGGTTAT
CATCATCAGAATGAACAGGGATCAGGCTATGCAGCGGATCAAAAAAGCAC
ACAAAATGCCATTAACGGGATTACAAACAAGGTGAACACTGTTATCGAGA
AAATGAACATTCAATTCACAGCTGTGGGTAAAGAATTCAACAAATTAGAA
AAAAGGATGGAAAATTTAAATAAAAAAGTTGATGATGGATTTCTGGACAT
TTGGACATATAATGCAGAATTGTTAGTTCTACTGGAAAATGAAAGGACTC
TGGATTTCCATGACTCAAATGTGAAGAATCTGTATGAGAAAGTAAAAAGC
CAATTAAAGAATAATGCCAAAGAAATCGGAAATGGATGTTTTGAGTTCTA
CCACAAGTGTGACAATGAATGCATGGAAAGTGTAAGAAATGGGACTTATG
ATTATCCCAAATATTCAGAAGAGTCAAAGTTGAACAGGGAAAAGGTAGAT
GGAGTGAAATTGGAATCAATGGGGATCTATCAGACGCGTACCGGTCATCA
TCACCATCACCATTGA

SEQ ID NO: 171 FOR PRIMER
ATTCTCCGGCGGCCGCTCGACACAATATGTATAGGCTACC

SEQ ID NO: 172 REV PRIMER
AGTCTTGCGGCCGCCTATTAATGGTGATGGTGATGATGCTGATAGATCCC
CATTGATTCC

SEQ ID NO: 173 HA0s
GACACAATATGTATAGGCTACCATGCGAACAATTCAACCGACACTGTTGA
CACAGTACTCGAGAAGAATGTGACAGTGACACACTCTGTTAACCTGCTCG
AAGACAGCCACAACGGAAAACTATGTAGATTAAAAGGAATAGCCCCACTA
CAATTGGGGAAATGTAACATCGCCGGATGGCTTTTGGGAAACCCAGAATG
CGACCCACTGCTTCCAGTGAGATCATGGTCCTACATTGTAGAAACACCAA
ACTCTGAGAATGGAATATGTTATCCAGGAGATTTCATCGACTATGAGGAG
CTGAGGGAGCAATTGAGCTCAGTGTCATCATTCGAAAGATTCGAAATATT
TCCCAAAGAAAGCTCATGGCCCAACCACAACACAAACGGAGTAACGGCAG
CATGCTCCCATGAGGGGAAAAGCAGTTTTTACAGAAATTTGCTATGGCTG
ACGGAGAAGGAGGGCTCATACCCAAAGCTGAAAAATTCTTATGTGAACAA
AAAAGGGAAAGAAGTCCTTGTACTGTGGGGTATTCATCACCCGCCTAACA
GTAAGGAACAACAGAATCTCTATCAGAATGAAAATGCTTATGTCTCTGTA
GTGACTTCAAATTATAACAGGAGATTTACCCCGGAAATAGCAGAAAGACC
CAAAGTAAGAGATCAAGCTGGGAGGATGAACTATTACTGGACCTTGCTAA
AACCCGGAGACACAATAATATTTGAGGCAAATGGAAATCTAATAGCACCA
ATGTATGCTTTCGCACTGAGTAGAGGCTTTGGGTCCGGCATCATCACCTC
AAACGCATCAATGCATGAGTGTAACACGAAGTGTCAAACACCCCTGGGAG
CTATAAACAGCAGTCTCCCTTACCAGAATATACACCCAGTCACAATAGGA
GAGTGCCCAAAATACGTCAGGAGTGCCAAATTGAGGATGGTTACAGGACT
AAGGAACATTCCGTCCATTCAATCCAGAGGTCTATTTGGAGCCATTGCCG
GTTTTATTGAAGGGGGATGGACTGGAATGATAGATGGATGGTATGGTTAT
CATCATCAGAATGAACAGGGATCAGGCTATGCAGCGGATCAAAAAAGCAC
ACAAAATGCCATTAACGGGATTACAAACAAGGTGAACACTGTTATCGAGA
AAATGAACATTCAATTCACAGCTGTGGGTAAAGAATTCAACAAATTAGAA
AAAAGGATGGAAAATTTAAATAAAAAAGTTGATGATGGATTTCTGGACAT
TTGGACATATAATGCAGAATTGTTAGTTCTACTGGAAAATGAAAGGACTC
TGGATTTCCATGACTCAAATGTGAAGAATCTGTATGAGAAAGTAAAAAGC
CAATTAAAGAATAATGCCAAAGAAATCGGAAATGGATGTTTTGAGTTCTA
CCACAAGTGTGACAATGAATGCATGGAAAGTGTAAGAAATGGGACTTATG
ATTATCCCAAATATTCAGAAGAGTCAAAGTTGAACAGGGAAAAGGTAGAT
GGAGTGAAATTGGAATCAATGGGGATCTATCAG

SEQ ID NO: 174 FOR PRIMER
AGGCAAGATCTGACACAATATGTATAGGCTACC

SEQ ID NO: 175 REV PRIMER
AGTCAGACGCGTCTATTAACGTAACAGAGACAGCAC

SEQ ID NO: 176 HA0sHis (PR8)
DTICIGYHANNSTDTVDTVLEKNVTVTHSVNLLEDSHNGKLCRLKGIAPL
QLGKCNIAGWLLGNPECDPLLPVRSWSYIVETPNSENGICYPGDFIDYEE
LREQLSSVSSFERFEIFPKESSWPNHNTNGVTAACSHEGKSSFYRNLLWL
TEKEGSYPKLKNSYVNKKGKEVLVLWGIHHPPNSKEQQNLYQNENAYVSV
VTSNYNRRFTPEIAERPKVRDQAGRMNYYWTLLKPGDTIIFEANGNLIAP
MYAFALSRGFGSGIITSNASMHECNTKCQTPLGAINSSLPYQNIHPVTIG
ECPKYVRSAKLRMVTGLRNIPSIQSRGLFGAIAGFIEGGWTGMIDGWYGY
HHQNEQGSGYAADQKSTQNAINGITNKVNTVIEKMNIQFTAVGKEFNKLE
KRMENLNKKVDDGFLDIWTYNAELLVLLENERTLDFHDSNVKNLYEKVKS
QLKNNAKEIGNGCFEFYHKCDNECMESVRNGTYDYPKYSEESKLNREKVD
GVKLESMGIYQHHHHHH

SEQ ID NO: 177 STF2Δ.HA0s (PR8)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVHGAPVDPASPWTENPLQKIDAALAQ
VDALRSDLGAVQNRFNSAITNLGNTVNNLSEARSRIEDSDYATEVSNMSR
AQILQQAGTSVLAQANQVPQNVLSLLREFSRYPAQWRPLDTICIGYHANN
STDTVDTVLEKNVTVTHSVNLLEDSHNGKLCRLKGIAPLQLGKCNIAGWL
LGNPECDPLLPVRSWSYIVETPNSENGICYPGDFIDYEELREQLSSVSSF
ERFEIFPKESSWPNHNTNGVTAACSHEGKSSFYRNLLWLTEKEGSYPKLK
NSYVNKKGKEVLVLWGIHHPPNSKEQQNLYQNENAYVSVVTSNYNRRFTP
EIAERPKVRDQAGRMNYYWTLLKPGDTIIFEANGNLIAPMYAFALSRGFG
SGIITSNASMHECNTKCQTPLGAINSSLPYQNIHPVTIGECPKYVRSAKL
RMVTGLRNIPSIQSRGLFGAIAGFIEGGWTGMIDGWYGYHHQNEQGSGYA
ADQKSTQNAINGITNKVNTVIEKMNIQFTAVGKEFNKLEKRMENLNKKVD

-continued

DGFLDIWTYNAELLVLLENERTLDFHDSNVKNLYEKVKSQLKNNAKEIGN

GCFEFYHKCDNECMESVRNGTYDYPKYSEESKLNREKVDGVKLESMGIYQ

SEQ ID NO: 178 STF2
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGTCTCTGTTACGT

SEQ ID No:179 HA1-1his (PR8)
MKFLVNVALVFMVVYISYIYASHNGKLCRLKGIAPLQLGKCNIAGWLLGN

PECDPLLPVRSWSYIVETPNSENGICYPGDFIDYEELREQLSSVSSFERF

EIFPKESSWPNHNTNGVTAACSHEGKSSFYRNLLWLTEKEGSYPKLKNSY

VNKKGKEVLVLWGIHHPPNSKEQQNLYQNENAYVSVVTSNYNRRFTPEIA

ERPKVRDQAGRMNYYWTLLKPGDTIIFEANGNLIAPMYAFALSRGFGSGI

ITSNASMHECNTKCQTPLGAINSSLPYQNIHPVTIGECPKYVRHHHHHH

-continued

SEQ ID No:180 HA1-1his (VN)
MKFLVNVALVFMVVYISYIYAEKKHNGKLCDLDGVKPLILRDCSVAGWLL

GNPMCDEFINVPEWSYIVEKANPVNDLCYPGDFNDYEELKHLLSRINHFE

KIQIIPKSSWSSHEASLGVSSACPYQGKSSFFRNVVWLIKKNSTYPTIKR

SYNNTNQEDLLVLWGIHHPNDAAEQTKLYQNPTTYISVGTSTLNQRLVPR

IATRSKVNGQSGRMEFFWTILKPNDAINFESNGNFIAPEYAYKIVKKGDS

TIMKSELEYGNCNTKCQTPMGAINSSMPFHNIHPLTIGECPKYVKHHHHH

H

SEQ ID No:181 HA1-1his (IND)
MKFLVNVALVFMVVYISYIYAEKTHNGKLCDLDGVKPLILRDCSVAGWLL

GNPMCDEFINVPEWSYIVEKANPTNDLCYPGSFNDYEELKHLLSRINHFE

KIQIIPKSSWSDHEASSGVSSACPYLGSPSFFRNVVWLIKKNSTYPTIKK

SYNNTNQEDLLVLWGIHHPNDAAEQTRLYQNPTTYISIGTSTLNQRLVPK

IATRSKVNGQSGRMEFFWTILKPNDAINFESNGNFIAPEYAYKIVKKGDS

AIMKSELEYGNCNTKCQTPMGAINSSMPFHNIHPLTIGECPKYVKHHHHH

H

SEQ ID No:182 HA1-1his (NC)
MKFLVNVALVFMVVYISYIYASHNGKLCLLKGIAPLQLGNCSVAGWILGN

PECELLISKESWSYIVETPNPENGTCYPGYFADYEELREQLSSVSSFERF

EIFPKESSWPNHTVTGVSASCSHNGKSSFYRNLLWLTGKNGLYPNLSKSY

VNNKEKEVLVLWGVHHPPNIGNQRALYHTENAYVSVVSSHYSRRFTPEIA

KRPKVRDQEGRINYYWTLLEPGDTIIFEANGNLIAPWYAFALSRGFGSGI

ITSNAPMDECDAKCQTPQGAINSSLPFQNVHPVTIGECPKYVRHHHHHH

SEQ ID No:183 HA1-1 (MAL)
ACCACTACCCCAACCAAATCTCACTTCGCAAACCTGAAAGGCACTGAAAC

CCGTGGCAAGCTGTGTCCGAAGTGTCTGAACTGCACCGATCTGGACGTCG

CACTGGGTCGTCCGAAATGTACTGGTAACATTCCGTCCGCGCGTGTCTCC

ATCCTGCATGAAGTGCGTCCAGTGACCTCCGGCTGTTTTCCGATTATGCA

TGATCGTACTAAAATCCGTCAGCTGCCGAACCTGCTGCGTGGTTACGAAC

ACATTCGTCTGTCCACCCATAACGTTATCAACGCGGAAAACGCGCCGGGC

GGTAGCTATAAAATCGGTACCTCTGGTTCTTGCCCGAACGTGACTAACGG

TAACGGCTTCTTTGCAACCATGGCCTGGGCGGTCCCGAAAAACGACAACA

ACAAGACCGCGACCAATTCCCTGACCATCGAAGTCCCGTATATCTGCACC

GAAGGTGAAGATCAAATCACGGTTTGGGGCTTCCACTCCGACAACGAGGC

ACAAATGGCGAAACTGTACGGTGACAGCAAACCGCAAAAATTCACTAGCT

CCGCTAACGGTGTTACCACCCACTACGTTTCCCAGATCGGTGGTTTCCCA

AACCAGACCGAAGATGGTGGTCTGCCGCAGTCCGGTCGCATCGTTGTAGA

TTATATGGTGCAGAAAAGCGGTAAAACCGGTACCATCACCTACCAGCGTG

GCATCCTGCTGCCGCAGAAAGTTTGGTGCGCTTCCGGTCGTAGCAAAGTA

ATCAAAGGTTCCCTGCCGCTGATCGGTGAAGCAGACTGCCTGCACGAGAA

ATACGGCGGTCTGAACAAAAGCAAGCCGTACTATACCGGCGAACATGCGA

AAGCAATTGGTAACTGTCCAATTTGGGTGAAATAGTAG

-continued

SEQ ID No:184 STF2.HA1-1 (MAL)
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGTCTCTGTTAGCGACCACTACCCCAACCAAATCTCACTTCGCAAA

CCTGAAAGGCACTGAAACCCGTGGCAAGCTGTGTCCGAAGTGTCTGAACT

GCACCGATCTGGACGTCGCACTGGGTCGTCCGAAATGTACTGGTAACATT

CCGTCCGCGCGTGTCTCCATCCTGCATGAAGTGCGTCCAGTGACCTCCGG

CTGTTTTCCGATTATGCATGATCGTACTAAAATCCGTCAGCTGCCGAACC

TGCTGCGTGGTTACGAACACATTCGTCTGTCCACCCATAACGTTATCAAC

GCGGAAAACGCGCCGGGCGGTAGCTATAAAATCGGTACCTCTGGTTCTTG

CCCGAACGTGACTAACGGTAACGGCTTCTTTGCAACCATGGCCTGGGCGG

TCCCGAAAAACGACAACAACAAGACCGCGACCAATTCCCTGACCATCGAA

GTCCCGTATATCTGCACCGAAGGTGAAGATCAAATCACGGTTTGGGGCTT

-continued

CCACTCCGACAACGAGGCACAAATGGCGAAACTGTACGGTGACAGCAAAC

CGCAAAAATTCACTAGCTCCGCTAACGGTGTTACCACCCACTACGTTTCC

CAGATCGGTGGTTTCCCAAACCAGACCGAAGATGGTGGTCTGCCGCAGTC

CGGTCGCATCGTTGTAGATTATATGGTGCAGAAAAGCGGTAAAACCGGTA

CCATCACCTACCAGCGTGGCATCCTGCTGCCGCAGAAAGTTTGGTGCGCT

TCCGGTCGTAGCAAAGTAATCAAAGGTTCCCTGCCGCTGATCGGTGAAGC

AGACTGCCTGCACGAGAAATACGGCGGTCTGAACAAAAGCAAGCCGTACT

ATACCGGCGAACATGCGAAAGCAATTGGTAACTGTCCAATTTGGGTGAAA

TAGTAG

SEQ ID No:185 HA1-2 (MAL)
AAAGGCACTGAAACCCGTGGCAAGCTGTGTCCGAAGTGTCTGAACTGCAC

CGATCTGGACGTCGCACTGGGTCGTCCGAAATGTACTGGTAACATTCCGT

CCGCGCGTGTCTCCATCCTGCATGAAGTGCGTCCAGTGACCTCCGGCTGT

TTTCCGATTATGCATGATCGTACTAAAATCCGTCAGCTGCCGAACCTGCT

GCGTGGTTACGAACACATTCGTCTGTCCACCCATAACGTTATCAACGCGG

AAAACGCGCCGGGCGGTAGCTATAAAATCGGTACCTCTGGTTCTTGCCCG

AACGTGACTAACGGTAACGGCTTCTTTGCAACCATGGCCTGGGCGGTCCC

GAAAAACGACAACAACAAGACCGCGACCAATTCCCTGACCATCGAAGTCC

CGTATATCTGCACCGAAGGTGAAGATCAAATCACGGTTTGGGGCTTCCAC

TCCGACAACGAGGCACAAATGGCGAAACTGTACGGTGACAGCAAACCGCA

AAAATTCACTAGCTCCGCTAACGGTGTTACCACCCACTACGTTTCCCAGA

TCGGTGGTTTCCCAAACCAGACCGAAGATGGTGGTCTGCCGCAGTCCGGT

CGCATCGTTGTAGATTATATGGTGCAGAAAAGCGGTAAAACCGGTACCAT

CACCTACCAGCGTGGCATCCTGCTGCCGCAGAAAGTTTGGTGCGCTTCCG

GTCGTAGCAAAGTAATCAAAGGTTGATAG

SEQ ID No:186 STF2.HA1-2 (MAL)
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

GGCGATTATGAAGTTAACGTTGCTACTGACGGTACAGTAACCCTTGCGGC

-continued

TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGTCTCTGTTAGCGAAAGGCACTGAAACCCGTGGCAAGCTGTGTCC
GAAGTGTCTGAACTGCACCGATCTGGACGTCGCACTGGGTCGTCCGAAAT
GTACTGGTAACATTCCGTCCGCGCGTGTCTCCATCCTGCATGAAGTGCGT
CCAGTGACCTCCGGCTGTTTTCCGATTATGCATGATCGTACTAAAATCCG
TCAGCTGCCGAACCTGCTGCGTGGTTACGAACACATTCGTCTGTCCACCC
ATAACGTTATCAACGCGGAAAACGCGCCGGGCGGTAGCTATAAAATCGGT
ACCTCTGGTTCTTGCCCGAACGTGACTAACGGTAACGGCTTCTTTGCAAC
CATGGCCTGGGCGGTCCCGAAAAACGACAACAACAAGACCGCGACCAATT
CCCTGACCATCGAAGTCCCGTATATCTGCACCGAAGGTGAAGATCAAATC
ACGGTTTGGGGCTTCCACTCCGACAACGAGGCACAAATGGCGAAACTGTA
CGGTGACAGCAAACCGCAAAAATTCACTAGCTCCGCTAACGGTGTTACCA
CCCACTACGTTTCCCAGATCGGTGGTTTCCCAAACCAGACCGAAGATGGT
GGTCTGCCGCAGTCCGGTCGCATCGTTGTAGATTATATGGTGCAGAAAAG
CGGTAAAACCGGTACCATCACCTACCAGCGTGGCATCCTGCTGCCGCAGA
AAGTTTGGTGCGCTTCCGGTCGTAGCAAAGTAATCAAAGGTTGATAG

SEQ ID No:187 HA1-2 (SH)
AAAGGCACTCGTACCCGCGGTAAGCTGTGCCCGGACTGCCTGAACTGTAC
CGATCTGGATGTTGCACTGGGTCGTCCGATGTGCGTTGGTACCACCCCGT
CTGCGAAAGCCAGCATCCTGCACGAAGTTCGCCCGGTTACTTCCGGTTGT
TTCCCGATTATGCATGATCGTACCAAAATTCGTCAGCTGCCAAACCTGCT
GCGTGGCTATGAAAACATTCGTCTGTCCACTCAAAACGTAATCGATGCAG
AAAAAGCGCTGGGTGGCCCGTATCGTCTGGGTACCAGCGGCTCCTGCCCG
AACGCGACGAGCAAAAGCGGCTTCTTCGCCACCATGGCTTGGGCCGTTCC
GAAAGACAACAACAAAAACGCTACGAACCCGCTGACCGTCGAAGTCCCGT
ACATCTGCACCGAAGGCGAAGATCAGATCACTGTGTGGGGCTTCCACAGC
GATGATAAGACCCAGATGAAAAATCTGTACGGTGACTCCAACCCGCAGAA
ATTCACCTCTTCTGCTAACGGTGTAACGACCCACTACGTTTCTCAGATCG
GTGGTTTCCCGGACCAGACGGAAGATGGCGCTCTGCCTCAGTCCGGCCGC
ATCGTAGTTGATTACATGGTCCAGAAACCGGGTAAGACTGGTACCATTGT
TTACCAGCGTGGTGTACTGCTGCCGCAGAAGGTCTGGTGTGCTTCCGGCC
GTTCCAAGGTCATTAAGGGCTGATA

SEQ ID No:188 STF2.HA1-2 (SH)
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGTCTCTGTTAGCGAAAGGCACTCGTACCCGCGGTAAGCTGTGCCC
GGACTGCCTGAACTGTACCGATCTGGATGTTGCACTGGGTCGTCCGATGT
GCGTTGGTACCACCCCGTCTGCGAAAGCCAGCATCCTGCACGAAGTTCGC
CCGGTTACTTCCGGTTGTTTCCCGATTATGCATGATCGTACCAAAATTCG
TCAGCTGCCAAACCTGCTGCGTGGCTATGAAAACATTCGTCTGTCCACTC
AAAACGTAATCGATGCAGAAAAAGCGCTGGGTGGCCCGTATCGTCTGGGT

-continued

ACCAGCGGCTCCTGCCCGAACGCGACGAGCAAAAGCGGCTTCTTCGCCAC

CATGGCTTGGGCCGTTCCGAAAGACAACAACAAAAACGCTACGAACCCGC

TGACCGTCGAAGTCCCGTACATCTGCACCGAAGGCGAAGATCAGATCACT

GTGTGGGGCTTCCACAGCGATGATAAGACCCAGATGAAAAATCTGTACGG

TGACTCCAACCCGCAGAAATTCACCTCTTCTGCTAACGGTGTAACGACCC

ACTACGTTTCTCAGATCGGTGGTTTCCCGGACCAGACGGAAGATGGCGGT

CTGCCTCAGTCCGGCCGCATCGTAGTTGATTACATGGTCCAGAAACCGGG

TAAGACTGGTACCATTGTTTACCAGCGTGGTGTACTGCTGCCGCAGAAGG

TCTGGTGTGCTTCCGGCCGTTCCAAGGTCATTAAGGGCTGATAG

SEQ ID No:189 HA1-2 (Lee)
AAAGGCACTCAGACCCGTGGCAAGCTGTGTCCGAACTGTTTCAACTGCAC

CGATCTGGACGTTGCACTGGGTCGTCCGAAATGCATGGGTAACATCCCGT

CTGCGAAGGTAAGCATCCTGCACGAAGTTAAACCGGTAACCAGCGGCTGT

TTCCCGATCATGCACGACAAAACTAAAATTCGTCAGCTGCCGAACCTGCT

GCGTGGTTATGAGAACATTCGTCTGTCTACCTCTAATGTTATCAACGCGG

AGACTGCACCAGGTGGCCCATACAAAGTAGGTACCAGCGGTTCCTGTCCG

AACGTTGCGAATCGTAACGGCTTCTTCAACACTATGGCGTGGGTTATCCC

GAAAGATAACAATAAAACTGCAATTAACCCGGTAACTGTAGAAGTTCCGT

ACATCTGCTCCGAAGGCGAGGACCAGATTACGGTATGGGGCTTTCACAGC

GACGATAAAACCCAGATGGAGCGTCTGTACGGTGACTCTAACCCGCAGAA

ATTCACCTCCTCCGCGAACGGCGTTACCACCCACTATGTTTCTCAGATCG

GCGGTTTCCCGAATCAGACCGAAGACGAAGGCCTGAAGCAGTCCGGCCGT

ATTGTTGTAGACTACATGGTTCAGAAGCCGGGCAAAACTGGTACCATTGT

ATACCAGCGCGGCATCCTGCTGCCGCAGAAAGTTTGGTGCGCTTCCGGTC

GTAGCAAAGTAATCAAAGGTTGATAG

SEQ ID No:190 STF2.HA1-2 (Lee)
ATGGCACAAGTAATCAACACTAACAGTCTGTCGCTGCTGACCCAGAATAA

CCTGAACAAATCCCAGTCCGCACTGGGCACCGCTATCGAGCGTCTGTCTT

CTGGTCTGCGTATCAACAGCGCGAAAGACGATGCGGCAGGTCAGGCGATT

GCTAACCGTTTCACCGCGAACATCAAAGGTCTGACTCAGGCTTCCCGTAA

CGCTAACGACGGTATCTCCATTGCGCAGACCACTGAAGGCGCGCTGAACG

AAATCAACAACAACCTGCAGCGTGTGCGTGAACTGGCGGTTCAGTCTGCT

AACAGCACCAACTCCCAGTCTGACCTCGACTCCATCCAGGCTGAAATCAC

CCAGCGCCTGAACGAAATCGACCGTGTATCCGGCCAGACTCAGTTCAACG

GCGTGAAAGTCCTGGCGCAGGACAACACCCTGACCATCCAGGTTGGCGCC

AACGACGGTGAAACTATCGATATCGATCTGAAGCAGATCAACTCTCAGAC

CCTGGGTCTGGACTCACTGAACGTGCAGAAAGCGTATGATGTGAAAGATA

CAGCAGTAACAACGAAAGCTTATGCCAATAATGGTACTACACTGGATGTA

TCGGGTCTTGATGATGCAGCTATTAAAGCGGCTACGGGTGGTACGAATGG

TACGGCTTCTGTAACCGGTGGTGCGGTTAAATTTGACGCAGATAATAACA

AGTACTTTGTTACTATTGGTGGCTTTACTGGTGCTGATGCCGCCAAAAAT

-continued

GGCGATTATGAAGTTAACGTTGCTACTGACGGTACAGTAACCCTTGCGGC

TGGCGCAACTAAAACCACAATGCCTGCTGGTGCGACAACTAAAACAGAAG

TACAGGAGTTAAAAGATACACCGGCAGTTGTTTCAGCAGATGCTAAAAAT

GCCTTAATTGCTGGCGGCGTTGACGCTACCGATGCTAATGGCGCTGAGTT

GGTCAAAATGTCTTATACCGATAAAAATGGTAAGACAATTGAAGGCGGTT

ATGCGCTTAAAGCTGGCGATAAGTATTACGCCGCAGATTACGATGAAGCG

ACAGGAGCAATTAAAGCTAAAACTACAAGTTATACTGCTGCTGACGGCAC

TACCAAAACAGCGGCTAACCAACTGGGTGGCGTAGACGGTAAAACCGAAG

TCGTTACTATCGACGGTAAAACCTACAATGCCAGCAAAGCCGCTGGTCAT

GATTTCAAAGCACAACCAGAGCTGGCGGAAGCAGCCGCTAAAACCACCGA

AAACCCGCTGCAGAAAATTGATGCCGCGCTGGCGCAGGTGGATGCGCTGC

GCTCTGATCTGGGTGCGGTACAAAACCGTTTCAACTCTGCTATCACCAAC

CTGGGCAATACCGTAAACAATCTGTCTGAAGCGCGTAGCCGTATCGAAGA

TTCCGACTACGCGACCGAAGTTTCCAACATGTCTCGCGCGCAGATTCTGC

AGCAGGCCGGTACTTCCGTTCTGGCGCAGGCTAACCAGGTCCCGCAGAAC

GTGCTGTCTCTGTTAGCGAAAGGCACTCAGACCCGTGGCAAGCTGTGTCC

GAACTGTTTCAACTGCACCGATCTGGACGTTGCACTGGGTCGTCCGAAAT

GCATGGGTAACATCCCGTCTGCGAAGGTAAGCATCCTGCACGAAGTTAAA

CCGGTAACCAGCGGCTGTTTCCCGATCATGCACGACAAAACTAAAATTCG

TCAGCTGCCGAACCTGCTGCGTGGTTATGAGAACATTCGTCTGTCTACCT

CTAATGTTATCAACGCGGAGACTGCACCAGGTGGCCCATACAAAGTAGGT

ACCAGCGGTTCCTGTCCGAACGTTGCGAATCGTAACGGCTTCTTCAACAC

TATGGCGTGGGTTATCCCGAAAGATAACAATAAAACTGCAATTAACCCGG

TAACTGTAGAAGTTCCGTACATCTGCTCCGAAGGCGAGGACCAGATTACG

GTATGGGGCTTTCACAGCGACGATAAAACCCAGATGGAGCGTCTGTACGG

TGACTCTAACCCGCAGAAATTCACCTCCTCCGCGAACGGCGTTACCACCC

ACTATGTTTCTCAGATCGGCGGTTTCCCGAATCAGACCGAAGACGAAGGC

CTGAAGCAGTCCGGCCGTATTGTTGTAGACTACATGGTTCAGAAGCCGGG

CAAAACTGGTACCATTGTATACCAGCGCGGCATCCTGCTGCCGCAGAAAG

TTTGGTGCGCTTCCGGTCGTAGCAAAGTAATCAAAGGTTGATAG

SEQ ID No:191 HA1-2 (Ohio)
AAAGGCACTAAAACCCGTGGCAAGCTGTGTCCGAAGTGTCTGAACTGCAC

CGATCTGGACGTCGCACTGGGTCGTCCGAAATGTACTGGTAACATTCCGT

CCGCGGAAGTCTCCATCCTGCATGAAGTGCGTCCAGTGACCTCCGGCTGT

TTTCCGATTATGCATGATCGTACTAAAATCCGTCAGCTGCCGAACCTGCT

GCGTGGTTACGAACACATTCGTCTGTCCACCCATAACGTTATCAACGCGG

AAAAGGCGCCGGGCGGTCCCTATAAAATCGGTACCTCTGGTTCTTGCCCG

AACGTGACTAACGGTAACGGCTTCTTTGCAACCATGGCCTGGGCGGTCCC

GAAAAACGACAACAACAAGACCGCGACCAATTCCCTGACCATCGAAGTCC

CGTATATCTGCACCGAAGGTGAAGATCAAATCACGATTTGGGGCTTCCAC

TCCGACAGCGAGACACAAATGGCGAAACTGTACGGTGACAGCAAACCGCA

-continued

AAAATTCACTAGCTCCGCTAACGGTGTTACCACCCACTACGTTTCCCAGA
TCGGTGGTTTCCCAAACCAGACCGAAGATGGTGGTCTGCCGCAGTCCGGT
CGCATCGTTGTAGATTATATGGTGCAGAAAAGCGGTAAAACCGGTACCAT
CACCTACCAGCGTGGCATCCTGCTGCCGCAGAAAGTTTGGTGCGCTTCCG
GTCGTAGCAAAGTAATCAAAGGTTGATAG

SEQ ID No:192 STF2.HA1-2 (Ohio)
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGTCTCTCTGTTAGCGAAAGGCACTAAAACCCGTGGCAAGCTGTGTCC
GAAGTGTCTGAACTGCACCGATCTGGACGTCGCACTGGGTCGTCCGAAAT
GTACTGGTAACATTCCGTCCGCGGAAGTCTCCATCCTGCATGAAGTGCGT
CCAGTGACCTCCGGCTGTTTTCCGATTATGCATGATCGTACTAAAATCCG
TCAGCTGCCGAACCTGCTGCGTGGTTACGAACACATTCGTCTGTCCACCC
ATAACGTTATCAACGCGGAAAAGGCGCCGGGCGGTCCCTATAAAATCGGT
ACCTCTGGTTCTTGCCCGAACGTGACTAACGGTAACGGCTTCTTTGCAAC
CATGGCCTGGGCGGTCCCGAAAAACGACAACAACAAGACCGCGACCAATT
CCCTGACCATCGAAGTCCCGTATATCTGCACCGAAGGTGAAGATCAAATC
ACGATTTGGGGCTTCCACTCCGACAGCGAGACACAAATGGCGAAACTGTA
CGGTGACAGCAAACCGCAAAAATTCACTAGCTCCGCTAACGGTGTTACCA
CCCACTACGTTTCCCAGATCGGTGGTTTCCCAAACCAGACCGAAGATGGT
GGTCTGCCGCAGTCCGGTCGCATCGTTGTAGATTATATGGTGCAGAAAAG
CGGTAAAACCGGTACCATCACCTACCAGCGTGGCATCCTGCTGCCGCAGA
AAGTTTGGTGCGCTTCCGGTCGTAGCAAAGTAATCAAAGGTTGATAG SEQ ID No:193 FOR PRIMER
CGGATAACAATTCCCCTCTAG SEQ ID No:194 REV PRIMER
CGAAGTGAGATTTGGTTGGAGTAGTGGTCGCTAACAGAGACAGCACGTTC SEQ ID No:195 FOR PRIMER
CCCGCAGAACGTGCTGTCTCTGTTAGCGACCACTACCCCAACCAAATCTC SEQ ID No:196 REV PRIMER
CTATTTCACCCAAATTGGAC SEQ ID No:197 REV PRIMER
CACAGCTTGCCACGGGTTTCAGTGCCTTTCGCTAACAGAGACAGCACGTT
C SEQ ID No:198 FOR PRIMER
CCCGCAGAACGTGCTGTCTCTGTTAGCGAAAGGCACTGAAACCCGTGGC SEQ ID No:199 REV PRIMER
GACTAGACGCTCAGCTATCAACCTTTGATTACTTTGCTACGACC SEQ ID No:200 REV PRIMER
CACAGCTTACCGCGGGTACGAGTGCCTTTCGCTAACAGAGACAGCACGTT
C SEQ ID No:201 FOR PRIMER
CGGGATCCAAAGGCACTCGTACCCGCGGTAAG SEQ ID No:202 REV PRIMER
GACTAGACGCTCAGCTATCAGCCCTTAATGACCTTGGAACGGCC SEQ ID No:203 REV PRIMER
GCATAGTTTTCCTCTGGTCTGTGTTC-
CTTTCGCTAACAGAGACAGCACGTTC SEQ ID No:204 FOR PRIMER
AAAGGAACACAGACCAGAGG SEQ ID No:205 REV PRIMER
CTACTACCCTTTTATTACCTTGCTCC SEQ ID No:206 REV PRIMER
CACAGCTTGCCACGGGTTTTAGTGCCTTTCGCTAACAGAGACAGCACGTTC SEQ ID No:207 FOR PRIMER
AAAGGCACTAAAACCCGTGGC SEQ ID No:208 REV PRIMER
GACTAGACGCTCAGCTATCAACCTTTGATTACTTTGCTACGACC SEQ ID NO: 209 STF2.HA1-1 (MAL)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV -continued SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLATTTPTKSHFANLKGTETRGKLCPKCLNCTDLDVALGRPKCTGNI
PSARVSILHEVRPVTSGCFPIMHDRTKIRQLPNLLRGYEHIRLSTNNVIN
AENAPGGSYKIGTSGSCPNVTNGNGFFATMAWAVPKNDNNKTATNSLTIE
VPYICTEGEDQITVWGFHSDNEAQMAKLYGDSKPQKFTSSANGVTTHYVS
QIGGFPNQTEDGGLPQSGRIVVDYMVQKSGKTGTITYQRGILLPQKVWCA
SGRSKVIKGSLPLIGEADCLHEKYGGLNKSKPYYTGEHAKAIGNCPIWVK SEQ ID NO: 210 STF2.HA1-2 (MAL)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLAKGTETRGKLCPKCLNCTDLDVALGRPKCTGNIPSARVSILHEVR
PVTSGCFPIMHDRTKIRQLPNLLRGYEHIRLSTHNVINAENAPGGSYKIG
TSGSCPNVTNGNGFFATMAWAVPKNDNNKTATNSLTIEVPYICTEGEDQI
TVWGFHSDNEAQMAKLYGDSKPQKFTSSANGVTTHYVSQIGGFPNQTEDG
GLPQSGRIVVDYMVQKSGKTGTITYQRGILLPQKVWCASGRSKVIKG SEQ ID NO: 211 STF2.HA1-2 (SH)
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLAKGTRTRGKLCPDCLNCTDLDVALGRPMCVGTTPSAKASILHEVR
PVTSGCFPIMHDRTKIRQLPNLLRGYENIRLSTQNVIDAEKALGGPYRLG -continued TSGSCPNATSKSGFFATMAWAVPKDNNKNATNPLTVEVPYICTEGEDQIT
VWGFHSDDKTQMKNLYGDSNPQKFTSSANGVTTHYVSQIGGFPDQTEDGG
LPQSGRIVVDYMVQKPGKTGTIVYQRGVLLPQKVWCASGRSKVIKG SEQ ID NO: 212 STF2
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGCTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGTCTCTGTTACGT SEQ ID NO: 213 B/Yamagata/16/18 HA
MKAIIVLLMVVTSNADRICTGITSSNSPHVVKTATQGEVNVTGVIPLTTT
PTKSHFANLKGTKTRGKLCPNCLNCTDLDVALGRPMCMGTIPSAKASILH
EVRPVTSGCFPIMHDRTKIRQLPNLLRGYENIRLSTHNVINAERAPGGPY
RLGTSGSCPNVTSRNGFFATMAWAVPRDNKTATNPLTVEVPYICTKGEDQ
ITVWGFHSDDKTQMKNLYGDSNPQKFTSSANGVTTHYVSQIGDFPNQTED
GGLPQSGRIVVDYMVQKPGKTGTIVYQRGVLLPQKVWCASGRSKVIKGSL -continued

PLIGEADCLHEKYGGLNKSKPYYTGEHAKAIGNCPIWVKTPLKLANGTKY

RPPAKLLKERGFFGAIAGFLEGGWEGMIAGWHGYTSHGAHGVAVAADLKS

TQEAINKITKNLNSLSELEVKNLQRLSGAMDELHNEILELDEKVDDLRAD

TISSQIELAVLLSNEGIINSEDEHLLALERKLKKMLGPSAVDIGNGCFET

KHKCNQTCLDRIAAGTFNAGEFSLPTFDSLNITAASLNDDGLDNHTILLY

YSTAASSLAVTLMIAIFIVYMVSRDNVSCSICL

SEQ ID NO: 787 B/Victoria/2/87 HA
MKAIIVLLMVVTSNADRICTGITSSNSPHVVKTATQGEVNVTGVIPLTTT

PTKSHFANLKGTKTRGKLCPKCLNCTDLDVALGRPKCTGTIPSAKASILH

EVKPVTSGCFPIMHDRTKIRQLPNLLRGYEHIRLSTHNVINAETAPGGPY

KVGTSGSCPNVTNGNGFFATMAWAVPKNDNNKTATNPLTVEVPYICTEGE

DQITVWGFHSDNEAQMVKLYGDSKPQKFTSSANGVTTHYVSQIGGFPNQA

EDGGLPQSGRIVVDYMVQKSGKTGTITYQRGILLPQKVWCASGRSKVIKG

SLPLIGEADCLHEKYGGLNKSKPYYTGEHAKAIGNCPIWVKTPLKLANGT

KYRPPAKLLKEKGFFGAIAGFLEGGWEGMIAGWHGYTSHGAHGVAVAADL

KSTQEAINKITKNLNSLSELEVKNLQRLSGAMDELHNKILELDEKVDDLR

ADTISSQIELAVLLSNEGIINSEDEHLLALERKLKKMLGPSAVEIGNGCF

ETKHKCNQTCLDRIAAGTFNAGEFSLPTFDSLNITAASLNDDGLDNHTIL

LYYSTAASSLAVTLMIAIFIVYMVSRDNVSCSICL

Example 13

Flagellin Proteins with Engineered Cysteine Residues for Chemical Conjugation The crystal structure for the bacterial flagellin *S. typhimurium* flagellin type 2 (STF2, SEQ ID NO: 312) has been reported (Yonekura, K., et al., *Nature* 424:643-650 (2003)). Complete atomic model of the bacterial flagellar filament by electron cryomicroscopy has been reported, and the most detailed structure-function study of the TLR5 activation was based on this structure (Smith, K. D., et al., *Nature Immunology* 4:1247-1253 (2003)). Toll-like Receptor 5 (TLR5) recognizes a conserved site on flagellin required for protofilament formation and bacterial motility (*Nature Immunology* 4(12):1247-1253). Mutational analysis demonstrated that the TLR5 activity of flagellin resides in two regions in the N- and C-terminal domains, stretches of 39 and 31 amino acids, respectively (Smith, et al.). These regions are highlighted in grey in FIG. 18. Alanine-scanning mutagenesis of these regions identified a number of mutations which reduced TLR5 activation, but no single mutation completely abrogated activity, suggesting that there is a degree of flexibility or redundancy in the TLR5 binding site. This makes sense from an evolutionary perspective, otherwise the bacteria could easily evolve to evade detection by TLR5. Deletion of the hypervariable hinge region and retention of the conserved N- and C-terminal domains results in a protein (STF2Δ) that retains full TLR5 activity, demonstrating that the N- and C-terminal domains (together) are necessary and sufficient for TLR5 activation.

Figure 19:
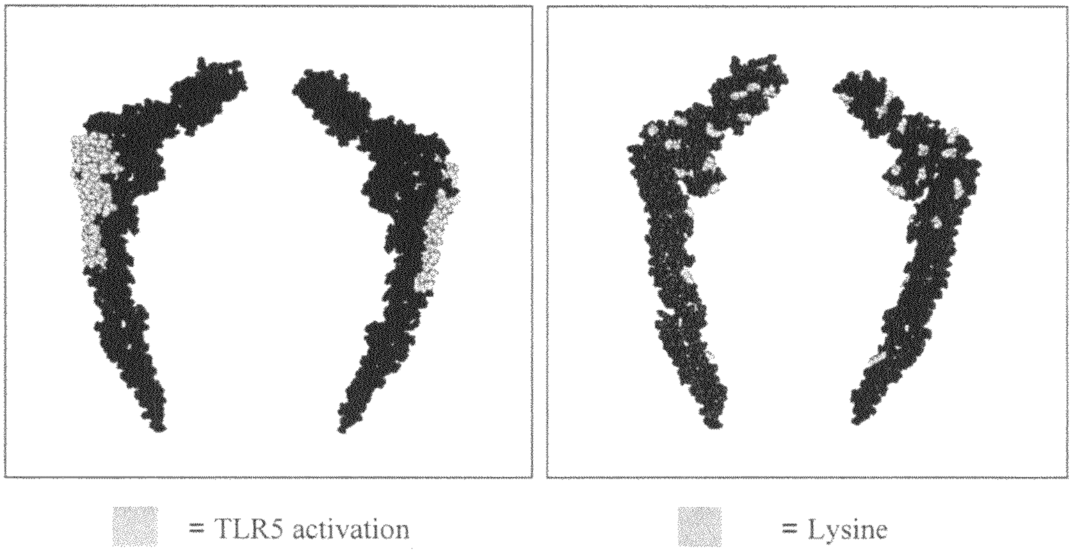
FIG. 19 depicts a space-filling model of flagellin (STF2) with the TLR5 activation site (left panel) and lysine residues (right panel) highlighted in gray.
Figure 20:
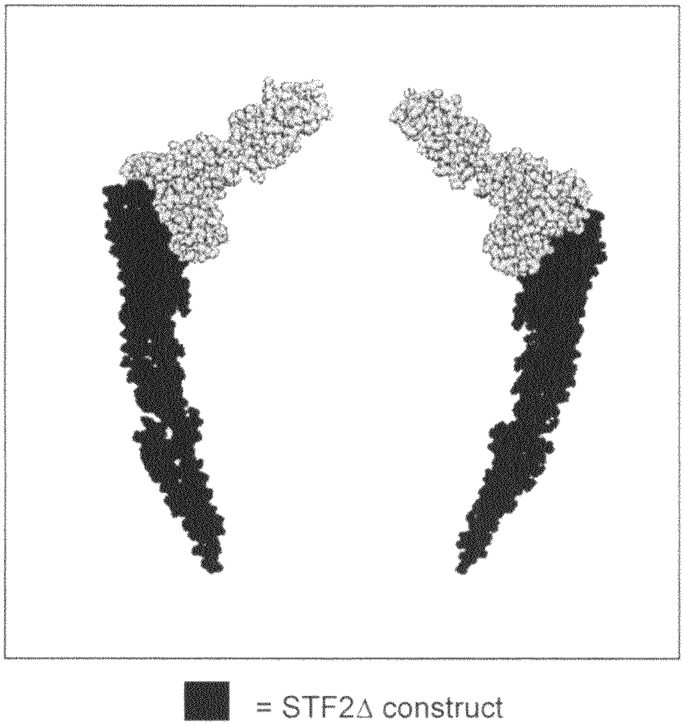
FIG. 20 depicts a space-filling model of flagellin (STF2) with residues retained in STF2Δ highlighted in black.

Lysine residues are convenient substrates for chemical conjugation of diverse chemical structures to a protein carrier such as flagellin. Of the 30 lysine residues in STF2 (SEQ ID NO: 312), only one lies within the experimentally-defined TLR5 activation site, and this particular lysine is not conserved among all bacterial flagellins (Smith, et al., *Nature Immunology* 4:1247-1253 (2003)). Of the remaining 29 lysines, 24 are located in the hypervariable hinge region of flagellin, thus leaving only 5 lysine residues in STF2Δ (SEQ ID NO: 313). The structure in FIGS. 19 and 20 shows that most lysines are spatially distal to the TLR5 activation domain, thus it would seem that lysines could be randomly conjugated with peptide or carbohydrate antigens with a reasonable probability of not interfering with the TLR5 activity of the resulting conjugated STF2Δ (SEQ ID NO: 313) protein. Five lysines appear to border the TLR5 activation site quite closely; these residues would be the first to consider mutating if antigen conjugation to lysine affects TLR5 activity.

Possible additional sites for conjugation (such as cysteines or additional lysines) may be engineered into full-length flagellin (STF2 (SEQ ID NO: 312)) or STF2Δ (SEQ ID NO: 313) by placing such residues in the hypervariable region or in the tail of the conserved N- and C-terminal domains distal to the TLR5 binding site. Chemical methods for conjugation to other amino acids also exist. These include carboxy amino acids (glutamic acid, aspartic acid) and the carboxyl terminal amino acid, arginine, histidine, tryptophan, tyrosine; and serine. Any of these strategies may be utilized to conjugate antigenic structures to flagellin without interfering with the TLR5 activation site.

Some types of antigens including polysaccharides are not amenable to recombinant fusion DNA technology nor to synthetic peptide chemistry, and thus cannot be genetically or synthetically linked to a ligand for a Toll-like Receptor (TLR). In addition, it is possible that genetic or synthetic fusion of a peptide to a TLR ligand may inhibit the proper folding of the TLR ligand. Chemical conjugation of the antigen to the TLR ligand, which is folded and purified, may be useful. The chemical conjugation of peptide antigens also permits the placement of antigen at specific sites on the TLR ligand, thus limiting interference with receptor binding of the TLR ligand or maximizing exposure to antigen receptors. The conjugation of many peptide antigens to a TLR ligand may also maximize immunogenicity by increasing the conformational heterogeneity with which antigen is presented to the immune system. To provide a site for chemical conjugation of such antigens to flagellin, a cysteine residue was engineered at different sites in the gene encoding STF2Δ (flagellin with the hypervariable hinge region deleted; SEQ ID NO: 313 and SEQ ID NO: 314).

Materials and Methods

Polymerase chain reaction (PCR): Platinum® PCR SuperMix High Fidelity kit (catalog number 12532-016, Invitrogen Corporation, Carlsbad, Calif.) was used for all PCR amplifications using the following protocol based on the manufacturer's instructions.

1. The following components were added in any order to each reaction tube:
   a. 45 μl Platinum® PCR SuperMix High Fidelity (PCR reaction buffer)
   b. Primer solution (10 pMol final concentration of each primer)
   c. Template DNA solution (10 ng plasmid DNA)
2. Reaction volume was made up to 50 μl with water
3. Tubes were capped and loaded in thermal cycler 4. Tubes were incubated at 94° C. for 30 to 120 seconds to completely denature the template and activate the enzyme
5. The following PCR amplification was performed for 25-35 cycles:
   a. Denature at 94° C. for 15-30 seconds
   b. Anneal at 50-55° C. for 15-30 seconds
   c. Extend at 68-72° C. for 1 minute per kb of PCR product size
   d. If necessary, cool to 4° C. and hold until ready for next process Construction of STF2Δ gene (SEQ ID NO: 314): Full length flagellin of *Salmonella typhimurium* fljb (STF2, SEQ ID NO: 312) is encoded by a 1.5 kb gene (SEQ ID NO: 315). To generate STF2Δ (SEQ ID NO: 314), the sequence corresponding to the hypervariable hinge region (amino acids 170 to 415 of SEQ ID NO: 312) was deleted and replaced with a short flexible linker (GAPVDPASPW (SEQ ID NO: 336)) designed to facilitate interactions of the $NH_2$ and COOH terminal sequences of STF2 (SEQ ID NO: 315) necessary for TLR5 signaling (Smith, K. D., et al., (2004). Toll-like Receptor 5 recognizes a conserved site on flagellin required for protofilament formation and bacterial motility (Smith, et al., *Nature Immunology* 4:1247-53 (2003)).

Figure 21:
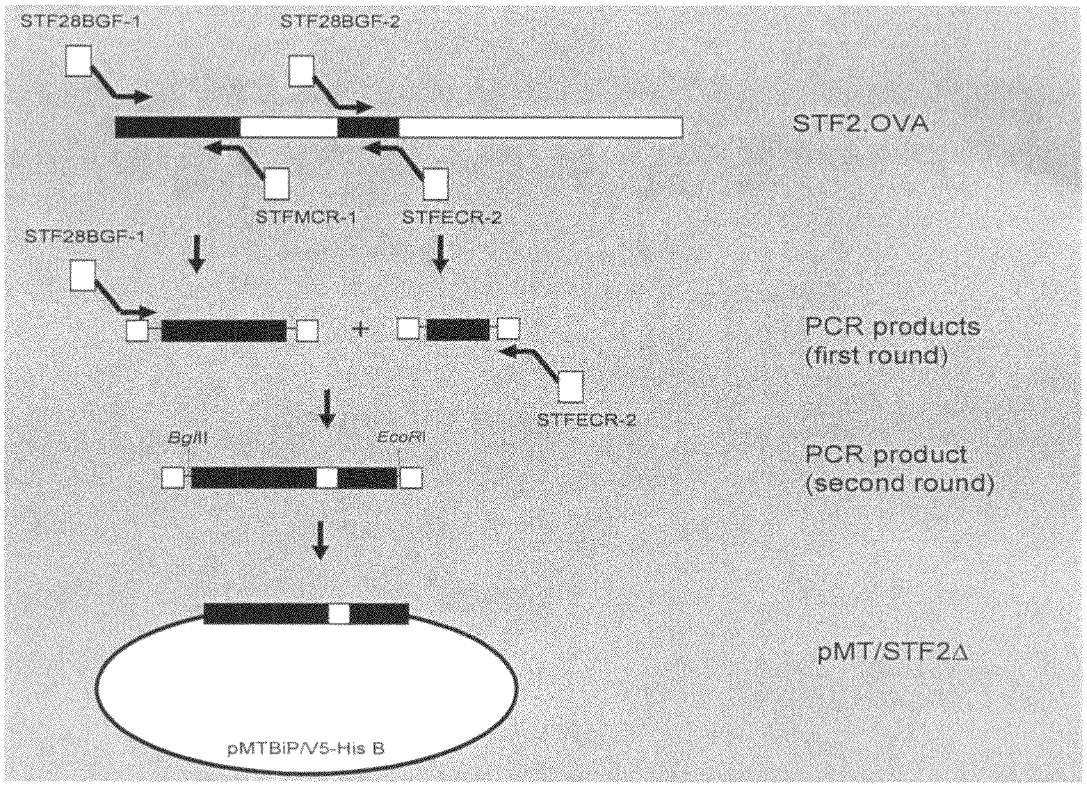
FIG. 21 depicts a schematic depiction of the two-step PCR cloning of pMT/STF2Δ.

To generate the STF2Δ plasmid, a two-step PCR was used (FIG. 21). In the first reaction, a plasmid encoding STF2.OVA (a fusion of full-length STF2 with full-length ovalbumin, SEQ ID NO: 316) was mixed with primers STF28BGF-1 (SEQ ID NO: 317) and STF28MCR-1 (SEQ ID NO: 318) in PCR reaction buffer, and the mixture was amplified in a PCR reaction as described above. In a parallel reaction, STF2.OVA template plasmid was mixed with primers STF28.MCF-2 (SEQ ID NO: 319) and STF28ECR-2 (SEQ ID NO: 320) in PCR reaction buffer, and the mixture was amplified in a PCR reaction as described above.

The PCR amplification reactions generated ~500 bp and 270 bp fragments, respectively. These PCR products were combined with primers STF28BGF-1 (SEQ ID NO: 317) and STF28ECR-2 (SEQ ID NO: 320) in PCR reaction buffer, and the mixture was amplified in a PCR reaction as described above. The amplified DNA product from this reaction (770 bp) was digested with BglII and EcoRI restriction enzymes for 2 hours at 37° C., and ligated into pMTBiP/V5-His B (Invitrogen, Carlsbad, Calif.) that had previously been digested with BglII and EcoRI and treated with calf intestinal phosphatase (CIP). An aliquot of the ligation mix was used to transform *E. coli* TOP10 cells. The resultant construct pMT/STF2Δ was used to generate the cysteine modified STF2Δ constructs.

Construction of STF2Δ genes engineered to express a single cysteine residue: To introduce cysteine residues at defined positions in the STF2 polypeptide, pMT/STF2Δ was used as a template in PCR with primer pairs as defined below.

To construct the STF2Δ.3'Cys (SEQ ID NO: 325) plasmid, pMT/STF2Δ plasmid was mixed with 3'Forward1 (SEQ ID NO: 321) and 3'Reverse1 (SEQ ID NO: 322) primers in PCR reaction buffer, and the mixture was amplified in a PCR reaction as described above.

To construct the 5'Cys.STF2Δ (SEQ ID NO: 326) plasmid, pMT/STF2Δ plasmid was mixed with 5'Forward2 (SEQ ID NO: 323) and 5'Reverse2 (SEQ ID NO: 324) primers in PCR reaction buffer, and the mixture was amplified in a PCR reaction as described above.

For STF2Δ.3'Cys (SEQ ID NO: 325) and 5'Cys.STF2Δ (SEQ ID NO: 326) constructs, the PCR products generated were digested with Nde1 and Blp1 restriction enzymes and purified by agarose gel electrophoresis. The purified fragments were ligated by compatible ends to pET24a (Novagen, Madison, Wis.) plasmid DNA that had been previously digested with Nde1 and Blp1 restriction enzymes and CIP-treated. The resulting constructs are designated pET/STF2Δ.3'Cys and pET/5'Cys. STF2Δ, respectively:

To construct the STF2Δ.HingeCys (SEQ ID NO: 331) plasmid, a two step PCR similar to that described in FIG. 18 was employed. One fragment was generated by mixing pMT/STF2Δ with paired HingeForward1 (SEQ ID NO: 327) and HingeReverse3 (SEQ ID NO: 328) primers in PCR reaction buffer, and the mixture was amplified in a PCR reaction as described above. Another fragment was generated by mixing pMT/STF2Δ with paired HingeForward2 (SEQ ID NO: 329) and HingeReverse4 (SEQ ID NO: 330) primers in PCR reaction buffer, and the mixture was amplified in a PCR reaction as described above. Aliquots from each of these PCR reactions were combined and mixed with HingeForward1 (SEQ ID NO: 327) and HingeReverse4 (SEQ ID NO: 330) primers in PCR reaction buffer, and the mixture was amplified in a PCR reaction as described above. The final PCR product was purified by agarose gel electrophoresis and digested with Nde1 and Blp1, and the purified fragment was ligated into the pET24a vector as described above. The resulting construct is designated pET/STF2Δ.HingeCys.

Protein expression: Plasmids pET/STF2Δ.3 Cys, pET/5'Cys.STF2Δ, and pET/STF2Δ.HingeCys were transformed into competent *E. coli* BLR(DE3) cells as follows. To a 1.5-ml snap-cap polypropylene tubes pre-chilled on ice was added 20 μl aliquot of BLR (DE3) cells and 1 μl plasmid DNA (1 μl/μl), and the mixture was incubated for 30 minutes. The tubes were heated for exactly 30 seconds in a 42° C. water bath without shaking, and then placed on ice for an additional 2 minutes. To each tube of heat shocked cells were added 250 μl of room temperature SOC medium.

The cells were recovered at 37° C. (shaking at 250 rpm) for 60 minutes prior to plating on selective media containing kanamycin. Various aliquots (50-100 μl) of the transformation mix were plated and the plates were incubated at 37° C. for 15 to 18 hours. Colonies were picked and inoculated into 2 ml Luria-Bertani (LB) broth supplemented with 25 μg/ml kanamycin and 12.5 μg/ml tetracycline, and cultured overnight. Fresh LB cultures were inoculated by diluting an aliquot of the overnight cultures 1:100 and cultured at 37° C. with shaking. When the $OD_{600}$ of the culture reached 0.6 to 1.0, protein expression was induced by the addition of isopropyl thio-β-D-galactoside (IPTG) to a final concentration of 1 mM. Several hours after induction, the cells were harvested for analysis of protein expression by SDS-PAGE. Glycerol stocks were prepared from cultures grown in LB supplemented with 0.5% glucose, 25 μg/ml kanamycin and 12.5 μg/ml tetracycline and were frozen at −80° C. following the addition of glycerol (7% final).

Protein purification: Proteins STF2Δ.3'Cys (SEQ ID NO: 332) and STF2Δ.HingeCys (SEQ ID NO: 333) were expressed and purified as follows. Glycerol stocks of *E. coli* BLR(DE3) cells harboring the desired plasmids were inoculated into 10 L shake-flasks containing LB and incubated at 37° C. with constant shaking. When cultures reached an optical density of $A_{600}$=0.8, protein expression was induced by the addition of 1 mM IPTG and cultures were incubated at 37° C. with constant shaking for 4 hours before harvesting. Cells were collected from 10 L of culture by low-speed centrifugation at 5,000 rpm (SLA3000 rotor) for 10 minutes and suspended in 50 mM Tris-HCl pH 8.0, 1 mM EDTA, 1 mM DTT (100 ml/10 L).

The cells were disrupted by passing the cell suspension twice through a microfluidizer at 18,000 psi. The insoluble material was separated from soluble proteins by centrifugation at 10,000 rpm (SS34 rotor) for 15 minutes. Under the culture conditions described, all STF2Δ proteins fractionated with the insoluble material and formed stable inclusion bodies that were collected as a solid pellet following centrifugation. The inclusion bodies were washed twice with 50 mM Tris-HCl, pH 8.0, 0.1 M NaCl and 0.5% Triton X-100, followed by two washes with the same buffer without detergent. Each wash was performed using a dounce homogenizer and the cleaned inclusion bodies (IBs) were collected by centrifugation at 10,000 rpm (SS34 rotor) for 15 minutes. The purified IBs were washed a final time with 50 mM Tris-HCl, pH 8.0 and stored as a cell pellet at −80° C. until needed.

IB material was thawed and solubilized in 8 M urea at pH 4.0. This step selectively solubilized the target protein while leaving a significant amount of debris and contaminating proteins as a solid precipitate which was removed by centrifugation. Because of the single cysteine present in these proteins, all subsequent purification procedures were carried out using buffers containing 1 mM DTT as a reducing agent. Solubilized protein was captured using SP fast flow sepharose (30 ml, XK16) and selectively eluted with 8 M urea in 25 mM Na Acetate ($C_2H_3O_2Na$), pH 4.0, 1 mM DTT, 1 mM EDTA and 0.2 M NaCl. To eliminate protein precipitation following this step, the pH of the SP elution was adjusted from 4.0 to 8.0 by dialysis against 50 mM Tris-HCl, pH 8.0, 1 mM DTT, 1 mM EDTA before protein refolding. The dialyzed material was refolded by direct dilution (10-fold) into 50 mM Tris-HCl pH 8.0, 1 mM DTT and 1 mM EDTA such that the final protein concentration was less than 0.1 mg/ml. The refolded SP pool was loaded directly onto Q high performance sepharose (30 ml, XK16) and bound protein was eluted with a 20 column volume linear gradient from 0 to 0.5 M NaCl in 50 mM Tris-HCl, pH 8.0, 1 mM DTT, 1 mM EDTA. This chromatography step yielded a single peak that eluted at a conductivity of approximately 15 ms/cm. The eluted material was pooled and stored at −80° C.

Protein characterization: Proteins were characterized for purity, identity endotoxin content, and biological activity using the following assays.

SDS-PAGE: Proteins (typically 5 μg) were diluted in SDS-PAGE sample buffer (1% SDS, 30 mM Tris-HCl, pH 6.8, 4% glycerol, 0.1 mg/ml bromophenol blue) with and without 5 mM α-mercaptoethanol. The samples were boiled for 5 minutes and loaded onto a 4-20% SDS polyacrylamide gel. Following electrophoresis, gels were stained with coomassie blue to visualize protein bands.

Endotoxin assay: Endotoxin levels were measured using the QCL-1000 Quantitative Chromogenic LAL test kit (BioWhittaker #50-648U), following the manufacturer's instructions for the microplate method.

Protein Assay: Protein concentrations were determined by the MicroBCA Protein Assay Reagent Kit in a 96-well format using BSA as a standard (Pierce Biotechnology), following the manufacturer's instructions.

Flagellin ELISA: Protein integrity and concentration were examined by ELISA with antibodies specific for flagellin. 96-well ELISA plates were coated overnight at 4° C. with serial dilutions of each target protein, in PBS starting at 5 μg/ml. Plates were blocked with 200 μl/well of Assay Diluent Buffer (ADB; BD Pharmingen) for one hour at room temperature then washed three times in phosphate-buffered saline containing Tween-20 (PBS-T, 12 mM $NaPO_4$, 137 mM NaCl, 2.7 mM KCl, 0.05% Tween 20). Rabbit polyclonal anti-flagellin antibody diluted in ADB (100 μl/well, 1:5000) was added to all wells and the plates were incubated for 1 hour at room temperature or overnight at 4° C., then washed three times with PBS-T. HRP-labeled goat anti-rabbit IgG antibody (Jackson Immunochemical) diluted in ADB was added (100 μl/well, 1:5000) and the plates were incubated at room temperature for 1 hour. The plates were washed three times with PBS-T. After adding TMB Ultra substrate (Pierce) and monitoring color development, $A_{450}$ was measured on a Tecan Farcyte microplate spectrophotometer.

TLR5 bioactivity assay: HEK293 cells (ATCC, Cat#CRL-1573, Manassas, Va.) constitutively express TLR5, and secrete several soluble factors, including IL-8, in response to TLR5 signaling. Cells were seeded in 96 well microplates (50,000 cells/well), and recombinant test proteins were added. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce; Rockford, Ill., #M801E and #M802B) following the manufacturer's instructions. Optical density was measured using a microplate spectrophotometer Results and Discussion Protein yield and purity: The final yield and endotoxin levels of each protein are shown below.

| Protein | SEQ ID NO: | Yield (mg) | Endotoxin (EU/μg) |
|---|---|---|---|
| STF2Δ.3'Cys | 332 | 75.0 | 0.01 |
| STF2Δ.HingeCys | 333 | 117.0 | 0.004 |

Figure 22:
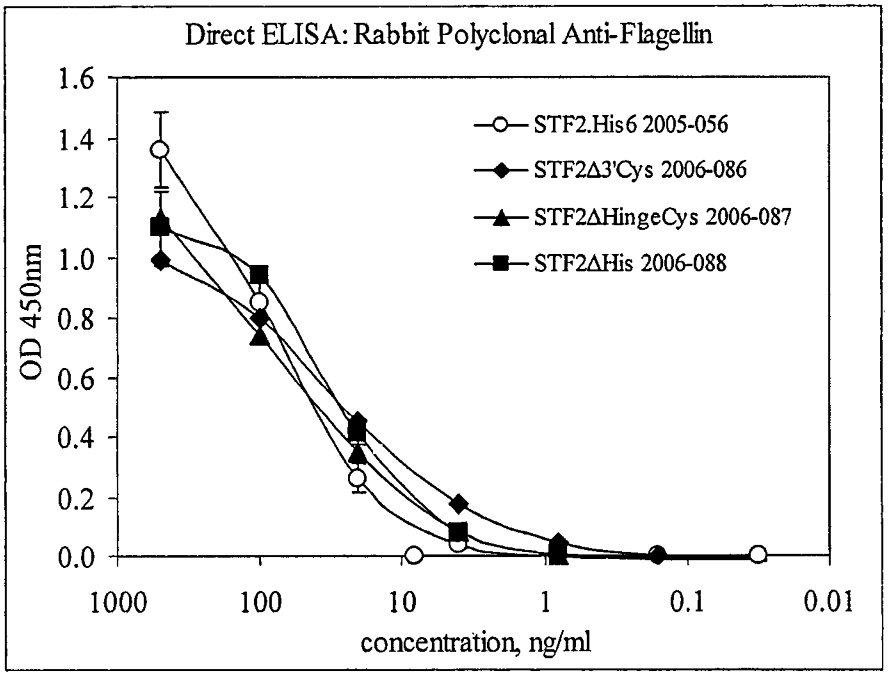
FIG. 22 depicts recognition of flagellin epitopes of STFΔ proteins in ELISA.

Flagellin integrity: Engineering a single cysteine into STF2Δ does not diminish its recognition by flagellin-specific antibodies, as shown in FIG. 22.

Figure 23:
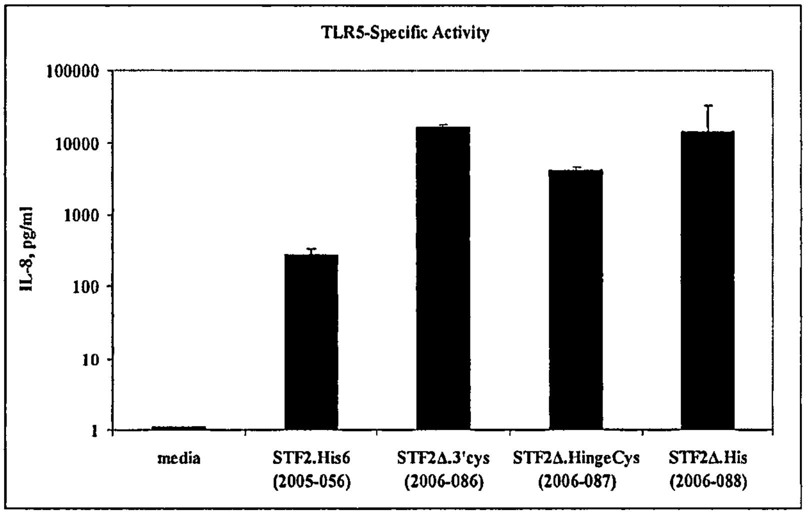
FIG. 23 depicts TLR5-dependent secretion of IL-8 following stimulation of HEK293 cells with the indicated STF2Δ proteins.

TLR5 agonist activity in the HEK293 IL-8 assay: Engineering a single cysteine into STF2Δ does not diminish the TLR agonist activity of the protein, as shown in FIG. 23. Cells exposed to STF2Δ. 3'Cys (SEQ ID NO: 332) or STF2Δ.HingeCys (SEQ ID NO: 333) secreted IL-8 at levels comparable to those induced by exposure to full-length flagellin (STF2, SEQ ID NO: 312) or STF2Δ without cysteine residues (SEQ ID NO: 313).

Fusion of full-length flagellin (STF2, SEQ ID NO: 312) or hinge region-deleted flagellin (STF2Δ, SEQ ID NO: 313) to a protein antigen such as West Nile virus envelope protein or influenza A hemagglutinatin significantly increases the immunogenicity of the fused antigen. This approach is useful for protein or peptide antigens which can be encoded in a genetic fusion construct expressing both flagellin and the antigen of interest in a single protein, but it cannot be applied to non-protein or non-peptide antigens, such as polysaccharide antigens. Since many bacteria and tumor cells express specific polysaccharide structures that are antigenic but poorly immunogenic, it is important to devise scalable methods for increasing the immunogenicity and protective efficacy of such structures. Chemical conjugation to a TLR ligand, such as flagellin, is one potential strategy.

There are several methods of chemical linkage, but one of the simplest is to couple an antigen to a free thiol group such as that on a single, unmatched cysteine residue. Since flagellin does not natively contain any cysteines, cysteine residues were engineered into flagellin at one of three positions: the amino terminus of flagellin (5'Cys.STF2Δ, SEQ ID NO: 326 and SEQ ID NO: 334), the carboxy terminus of flagellin (STF2Δ3'Cys, SEQ ID NO: 325 and SEQ ID NO: 332), and in the deleted hinge region of flagellin (STF2Δ.HingeCys, SEQ ID NO: 331 and SEQ ID NO: 333). All constructs were produced in the expression vector pET24a for *E. coli* expression. When purified from *E. coli* cells, STF2Δ.HingeCys (SEQ ID NO: 333) and STF2Δ. 3'Cys (SEQ ID NO: 332) proteins retain all antigenic and TLR5 biological activity properties of the unmodified STF2Δ protein, thus confirming that the introduction of a single cysteine residue does not negatively impact the expression, purification, refolding, or biological activity of STF2Δ.

Conjugation of Influenza Hemagglutinin Maturational Cleavage Site Peptide to STF2Δ.HingeCys A peptide representing the maturational cleavage site of influenza hemagglutinin was chemically conjugated a modified flagellin protein, STF2Δ.HingeCys (SEQ ID NO: 333).

Materials and Methods

Production of STF2Δ.HingeCys protein: STF2Δ.HingeCys protein (SEQ ID NO: 333) was expressed and purified as described in the previous Example.

Synthesis of H1C1 peptides The sequence $NH_2$-NIPSIQS-RGLFFAIAGFIE-COOH (SEQ ID NO: 337) represents the maturational cleavage site of influenza A/H1N1 hemagglutinin (Bianchi, E., et al. (2005). Universal influenza B vaccine based on the maturational cleavage site of the hemagglutinin precursor (Bianchi, et al., *J. Virol.* 79:7380-7388 (2005)). Two peptides were designed with an extra cysteine or an extra lysine on the N-terminus to facilitate chemical linkage to carrier proteins, resulting in the following peptide sequences:

CysH1C1 (SEQ ID NO: 338) $NH_2$-CNIPSIQSRGLFFAIAGFIE-COOH (SEQ ID NO: 338)

LysH1C1 (SEQ ID NO: 339) $NH_2$-KNIPSIQSRGLFFAIAGFIE-COOH (SEQ ID NO: 339)

The peptides were synthesized by Anaspec, Inc., (San Jose, Calif.) utilizing standard Fmoc chemistry, after which they were cleaved from the matrix with trifluoroacetic acid (TFA), purified by reversed-phase HPLC and lyophilized.

Conjugation of CysH1C1 peptide to STF2Δ.HingeCys: STF2Δ.HingeCys protein (SEQ ID NO: 333) at a concentration of 4.9 mg/mL was dialyzed overnight into Buffer A [1× phosphate-buffered saline (PBS), 5 mM EDTA, pH 7.2]. $BM(PEO)_2$ (Pierce Biotechnology, Rockford, Ill.), a homobifunctional maleimide crosslinker, was dissolved in DMSO (dimethyl sulfoxide) and added to a final concentration of 2.3 mM. After incubating for 1 hour at room temperature, the free crosslinker was removed from the protein using a 5 ml Superdex 25 HiTrap desalting column. CysH1C1 peptide (SEQ ID NO: 338) was dissolved in DMSO and added to the maleimide-derivatized STF2Δ.HingeCys protein at a final concentration of 0.32 mM. After incubating 3 hours at room temperature, the reaction was stopped by adding DTT (dithiothreitol) to a final concentration of 40 mM. The protein and protein-peptide conjugate were separated from free peptide by fractionation on a Superdex 200 10/300 size-exclusion chromatography (SEC) column (GE/Amersham; Piscataway, N.J.) equilibrated in 1× Tris-buffered saline (TBS), pH 8.0.

Protein characterization: Proteins were characterized for purity, identity, endotoxin content, and biological activity as described in the previous Example.

Results and Discussion

Characterization of the STF2Δ.HingeCys:CysH1C1 peptide conjugate: Conjugation of the CysH1C1 peptide (SEQ ID NO: 338) to STF2Δ.HingeCys (SEQ ID NO: 333) was assayed by SDS-PAGE with coomassie staining. Peptide conjugation to the protein resulted in a doublet band in which the faster-migrating band corresponded to the un-conjugated protein and the slower migrating band corresponded to the protein-peptide conjugate.

A cloudy precipitate was seen in the conjugation mixture due to the low solubility of the peptide. To ascertain if the protein-peptide conjugate was precipitating, the mixture was centrifuged (16,000×g for 15 minutes) and the resulting pellet and supernatant fractions analyzed by SDS-PAGE. The majority of the peptide-conjugated protein remains in the supernatant indicating that it is still soluble.

Figure 24:
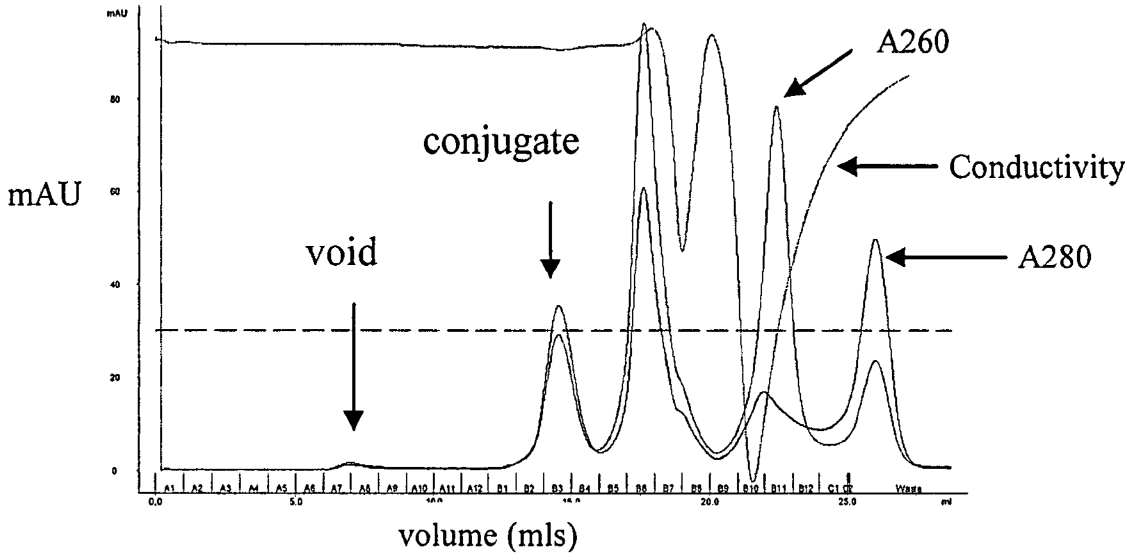
FIG. 24 depicts the S200 chromatogram of STF2Δ.HingeCys:CysH1C1. Void=column void volume; conjugate=elution peak of protein: peptide conjugate; A260, A280 and conductivity are indicated.

Size-exclusion chromatography (SEC) of the STF2Δ.HingeCys:CysH1C1 conjugate was performed to separate the conjugated protein from remaining crosslinker and unconjugated peptide. A single major protein peak eluted in the included range of the column at the expected volume for monomeric STF2Δ, while there is very little material eluting in the void (FIG. 24), indicating that most of the fractionating protein is monomeric.

Figure 25:
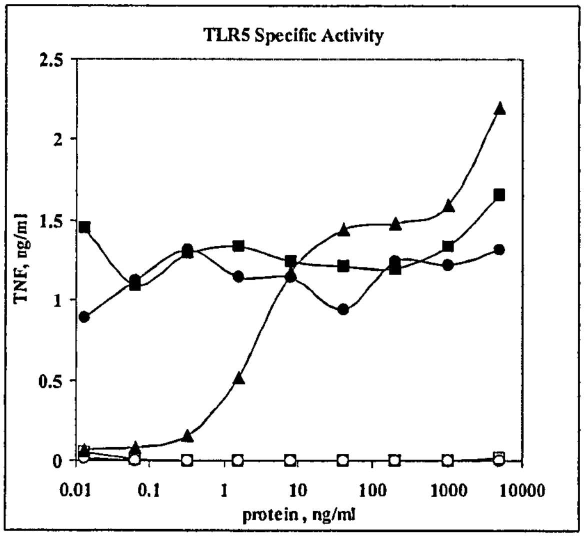
FIG. 25 depicts TLR5-dependent secretion of IL-8 following stimulation of RAWhTLR5 cells (closed symbols) or TLR5-negative RAW cells (open symbols) with STF2Δ.HingeCys (squares), STF2Δ.HingeCys:CysH1C1 conjugate (circles), or STF2.OVA (triangles).

The monomeric nature of the STF2Δ.HingeCys:CysH1C1 conjugate was confirmed by SDS-PAGE analysis of the S200 fractions (FIG. 25). The protein-peptide conjugate co-elutes with the unconjugated protein in the same ratio as in the load sample, indicating that the conjugate species is a monomer.

Bioactivity of the STF2Δ.HingeCys:CysH1C1 conjugate mixture was found to be equivalent to the unconjugated STF2Δ.HingeCys protein, indicating that the attachment of the $BM(PEO)_2$ crosslinker and the peptide conjugation reaction does not inhibit TLR5 stimulatory activity (FIG. 8).

Conjugation of a $Pam_3Cys$-Containing Lipopeptide to an Influenza Hemagglutinin Antigen Several types of Toll-like Receptors (TLRs) are potently activated by lipids or lipid-conjugates. These include TLR2/1 (diacyl lipoproteins and GPI-linked proteins), TLR2/6 (triacyl lipoproteins and GPI-linked proteins) and TLR4 (lipopolysaccharides). The utility of vaccines composed of antigens liked to such lipids is obvious: the lipids are strong activators of innate immune pathways and yet are themselves poorly immunogenic. However, the production of such conjugates is very complex. Biosynthesis of recombinant lipoproteins in bacteria is limited by low productivity and extreme difficulty in purifying the resulting protein-lipopeptide fusion. Chemical synthesis of lipopeptide antigens is more straight forward, but is limited to peptide antigens. Here we demonstrate the chemical conjugation of a $Pam_3Cys$ lipopeptide, a TLR2/6 agonist, to influenza HA1-1$His_6$ in a process which bypasses the difficulties inherent in both biosynthesis and complete chemical synthesis of lipidated antigens.

Materials and Methods

Production of HA1-1$His_6$(PR8)Bv (SEQ ID NO: 179) HA1-1$His_6$ (PR8)Bv was prepared as described herein.

Synthesis of $Pam_3CS(K)_4GC$ (SEQ ID NO: 335) Custom lipopeptide synthesis was performed by Anaspec, Inc. (San Jose, Calif.) using standard solid-phase Fmoc chemistry, after which the lipopeptide was cleaved from the matrix with trifluoroacetic acid (TFA), purified by reversed-phase HPLC and lyophilized.

Conjugation of $Pam_3CS(K)_4GC$ (SEQ ID NO:335) to HA1-1$His_6$(PR8)Bv (SEQ ID NO: 179) HA1-1$His_6$(PR8)Bv (SEQ ID NO: 179) was dialyzed into Buffer A (1×PBS+5 mM EDTA, pH 7.2). Sulfo-SMCC (Pierce; Rockland, Ill.) a heterobifunctional maleimide/NHS-ester crosslinker was dissolved in DMSO and added to a final concentration of 0.432 mM. After incubating for 30 min. at room temperature the protein was desalted into Buffer A using a G-25 HiTrap desalting column (GE/Amersham; Piscataway, N.J.). Triton X-114 (TX-114) (Sigma; St Louis, Mo.) was added to a final concentration of 1% (w/v). $Pam_3CS(K)_4GC$ was dissolved to 20 mg/ml in DMSO and added to a final concentration of 0.6 mg/ml. After incubating at room temperature for 3 hours, the reaction tube was placed in a 37° C. bath for 10 minutes to cause TX-114 droplet formation. The sample was then centrifuged at 16,000×g for 10 minutes to separate the detergent and aqueous phases. After drawing off the aqueous phase the detergent phase was resuspended to the original reaction volume with Buffer A. The total, detergent, and aqueous samples were then analyzed by SDS-PAGE.

Protein characterization: Proteins-lipopeptide conjugates were characterized by SDS-PAGE. Samples(typically 5 μg) were diluted in SDS-PAGE sample buffer (0.1 M Tris, pH 8.0/4% SDS/25% glycerol/0.1M DTT). The samples were boiled for 5 minutes and loaded onto a 10% SDS polyacrylamide gel. Following electrophoresis, gels were stained with coomassie blue to visualize protein bands.

Results and Discussion

Input HA1-1$His_6$(PR8)Bv (SEQ ID NO: 179) runs as a doublet band on SDS-PAGE. This has been seen for all of the HA1-1$His_6$ proteins made in *Baculovirus* to date and is likely due to differences in glycosylation. HA1-1$His_6$(PR8)Bv (SEQ ID NO: 179) which has been derivatized with Sulfo-SMCC but not conjugated to lipopeptide stays in the aqueous phase during TX-114 separation, the expected behavior for a soluble, globular protein. HA1-1$His_6$(PR8)Bv (SEQ ID NO: 179) conjugated to $Pam_3Cys$ shows 3 or 4 bands of higher molecular weight than the derivatized input protein, consistent with covalent modification by the lipopeptide. On TX-114 phase separation the higher mw species segregate primarily into the detergent phase while the lower species (corresponding to the unmodified protein) stay in the aqueous phase. This behavior is consistent with the commonly observed segregation of lipoproteins into detergent droplets and confirms that HA1-1$His_6$(PR8)Bv (SEQ ID NO: 179) has been covalently modified with the $Pam_3CS(K)_4GC$ (SEQ ID NO: 335) lipopeptide. The higher molecular-weight bands of approximately 60, 120, and 180 kDa, which are seen in the SMCC-derivatized protein but not in the input, are covalent HA1-1 multimers formed by the crosslinker. This multimerization would be prevented, and the yield of singly lipidated HA1-1 improved, by engineering a single cysteine into HA1-1 and using a cysteine-specific rather than a lysine-specific crosslinker. Such a strategy would also give better control over the site of attachment of the lipopeptide on HA1-1, giving a more homogeneous product and possibly improving immunogenicity

```
SEQ ID NO: 312, amino acid sequence of STF2
MAQVINTNSLSLLTQNNLNKSQSALGTAIERLSSGLRINSAKDDAAGQAIANRFTANIKG
LTQASRNANDGISIAQTTEGALNEINNNLQRVRELAVQSANSTNSQSDLDSIQAEITQRL
NEIDRVSGQTQFNGVKVLAQDNTLTIQVGANDGETIDIDLKQINSQTLGLDSLNVQKAYD
VKDTAVTTKAYANNGTTLDVSGLDDAAIKAATGGTNGTASVTGGAVKFDADNNKYFVTIG
GFTGADAAKNGDYEVNVATDGTVTLAAGATKTTMPAGATTKTEVQELKDTPAVVSADAKN
ALIAGGVDATDANGAELVKMSYTDKNGKTIEGGYALKAGDKYYAADYDEATGAIKAKTTS
YTAADGTTKTAANQLGGVDGKTEVVTIDGKTYNASKAAGHDFKAQPELAEAAAKTTENPL
QKIDAALAQVDALRSDLGAVQNRFNSAITNLGNTVNNLSEARSRIEDSDYATEVSNMSRA
QILQQAGTSVLAQANQVPQNVLSLLR
```

```
SEQ ID NO: 313, amino acid sequence of STF2Δ
MAQVINTNSLSLLTQNNLNKSQSALGTAIERLSSGLRINSAKDDAAGQAIANRFTANIKG
LTQASRNANDGISIAQTTEGALNEINNNLQRVRELAVQSANSTNSQSDLDSIQAEITQRL
NEIDRVSGQTQFNGVKVLAQDNTLTIQVGANDGETIDIDLKQINSQTLGLDSLNVHGAPV
DPASPWTENPLQKIDAALAQVDALRSDLGAVQNRFNSAITNLGNTVNNLSEARSRIEDSD
YATEVSNMSRAQILQQAGTSVLAQANQVPQNVLSLLR
```

```
SEQ ID NO: 314, nucleotide sequence of STF2Δ
ATGGCACAAGTAATCAACACTAACAGTCTGTCGCTGCTGACCCAGAATAACCTGAACAAA
TCCCAGTCCGCACTGGGCACCGCTATCGAGCGTCTGTCTTCTGGTCTGCGTATCAACAGC
GCGAAAGACGATGCGGCAGGTCAGGCGATTGCTAACCGTTTCACCGCGAACATCAAAGGT
CTGACTCAGGCTTCCCGTAACGCTAACGACGGTATCTCCATTGCGCAGACCACTGAAGGC
GCGCTGAACGAAATCAACAACAACCTGCAGCGTGTGCGTGAACTGGCGGTTCAGTCTGCT
AACAGCACCAACTCCCAGTCTGACCTCGACTCCATCCAGGCTGAAATCACCCAGCGCCTG
AACGAAATCGACCGTGTATCCGGCCAGACTCAGTTCAACGGCGTGAAAGTCCTGGCGCAG
GACAACACCCTGACCATCCAGGTTGGCGCCAACGACGGTGAAACTATCGATATCGATCTG
AAGCAGATCAACTCTCAGACCCTGGGTCTGGACTCACTGAACGTGCATGGAGCGCCGGTG
GATCCTGCTAGCCCATGGACCGAAAACCCGCTGCAGAAAATTGATGCCGCGCTGGCGCAG
GTGGATGCGCTGCGCTCTGATCTGGGTGCGGTACAAAACCGTTTCAACTCTGCTATCACC
AACCTGGGCAATACCGTAAACAATCTGTCTGAAGCGCGTAGCCGTATCGAAGATTCCGAC
TACGCGACCGAAGTTTCCAACATGTCTCGCGCGCAGATTTTGCAGCAGGCCGGTACTTCC
GTTCTGGCGCAGGCTAACCAGGTCCCGCAGAACGTGCTGTCTCTGTTACGT
```

SEQ ID NO: 315, nucleotide sequence of STF2
ATGGCACAAGTAATCAACACTAACAGTCTGTCGCTGCTGACCCAGAATAACCTGAACAAA
TCCCAGTCCGCACTGGGCACCGCTATCGAGCGTCTGTCTTCTGGTCTGCGTATCAACAGC
GCGAAAGACGATGCGGCAGGTCAGGCGATTGCTAACCGTTTCACCGCGAACATCAAAGGT
CTGACTCAGGCTTCCCGTAACGCTAACGACGGTATCTCCATTGCGCAGACCACTGAAGGC
GCGCTGAACGAAATCAACAACAACCTGCAGCGTGTGCGTGAACTGGCGGTTCAGTCTGCT
AACAGCACCAACTCCCAGTCTGACCTCGACTCCATCCAGGCTGAAATCACCCAGCGCCTG
AACGAAATCGACCGTGTATCCGGCCAGACTCAGTTCAACGGCGTGAAAGTCCTGGCGCAG
GACAACACCCTGACCATCCAGGTTGGCGCCAACGACGGTGAAACTATCGATATCGATCTG
AAGCAGATCAACTCTCAGACCCTGGGTCTGGACTCACTGAACGTGCAGAAAGCGTATGAT
GTGAAAGATACAGCAGTAACAACGAAAGCTTATGCCAATAATGGTACTACACTGGATGTA
TCGGGTCTTGATGATGCAGCTATTAAAGCGGCTACGGGTGGTACGAATGGTACGGCTTCT
GTAACCGGTGGTGCGGTTAAATTTGACGCAGATAATAACAAGTACTTTGTTACTATTGGT
GGCTTTACTGGTGCTGATGCCGCCAAAAATGGCGATTATGAAGTTAACGTTGCTACTGAC
GGTACAGTAACCCTTGCGGCTGGCGCAACTAAAACCACAATGCCTGCTGGTGCGACAACT
AAAACAGAAGTACAGGAGTTAAAAGATACACCGGCAGTTGTTTCAGCAGATGCTAAAAAT
GCCTTAATTGCTGGCGGCGTTGACGCTACCGATGCTAATGGCGCTGAGTTGGTCAAAATG
TCTTATACCGATAAAAATGGTAAGACAATTGAAGGCGGTTATGCGCTTAAAGCTGGCGAT
AAGTATTACGCCGCAGATTACGATGAAGCGACAGGAGCAATTAAAGCTAAAACTACAAGT
TATACTGCTGCTGACGGCACTACCAAAACAGCGGCTAACCAACTGGGTGGCGTAGACGGT
AAAACCGAAGTCGTTACTATCGACGGTAAAACCTACAATGCCAGCAAAGCCGCTGGTCAT
GATTTCAAAGCACAACCAGAGCTGGCGGAAGCAGCCGCTAAAACCACCGAAAACCCGCTG
CAGAAAATTGATGCCGCGCTGGCGCAGGTGGATGCGCTGCGCTCTGATCTGGGTGCGGTA
CAAAACCGTTTCAACTCTGCTATCACCAACCTGGGCAATACCGTAAACAATCTGTCTGAA
GCGCGTAGCCGTATCGAAGATTCCGACTACGCGACCGAAGTTTCCAACATGTCTCGCGCG
CAGATTCTGCAGCAGGCCGGTACTTCCGTTCTGGCGCAGGCTAACCAGGTCCCGCAGAAC
GTGCTGTCTCTGTTACGT SEQ ID NO: 316, nucleotide sequence of STF2.OVA
ATGGCACAAGTAATCAACACTAACAGTCTGTCGCTGCTGACCCAGAATAACCTGAACAAA
TCCCAGTCCGCACTGGGCACCGCTATCGAGCGTCTGTCTTCTGGTCTGCGTATCAACAGC
GCGAAAGACGATGCGGCAGGTCAGGCGATTGCTAACCGTTTCACCGCGAACATCAAAGGT
CTGACTCAGGCTTCCCGTAACGCTAACGACGGTATCTCCATTGCGCAGACCACTGAAGGC
GCGCTGAACGAAATCAACAACAACCTGCAGCGTGTGCGTGAACTGGCGGTTCAGTCTGCT
AACAGCACCAACTCCCAGTCTGACCTCGACTCCATCCAGGCTGAAATCACCCAGCGCCTG
AACGAAATCGACCGTGTATCCGGCCAGACTCAGTTCAACGGCGTGAAAGTCCTGGCGCAG
GACAACACCCTGACCATCCAGGTTGGCGCCAACGACGGTGAAACTATCGATATCGATCTG
AAGCAGATCAACTCTCAGACCCTGGGTCTGGACTCACTGAACGTGCAGAAAGCGTATGAT
GTGAAAGATACAGCAGTAACAACGAAAGCTTATGCCAATAATGGTACTACACTGGATGTA
TCGGGTCTTGATGATGCAGCTATTAAAGCGGCTACGGGTGGTACGAATGGTACGGCTTCT
GTAACCGGTGGTGCGGTTAAATTTGACGCAGATAATAACAAGTACTTTGTTACTATTGGT
GGCTTTACTGGTGCTGATGCCGCCAAAAATGGCGATTATGAAGTTAACGTTGCTACTGAC
GGTACAGTAACCCTTGCGGCTGGCGCAACTAAAACCACAATGCCTGCTGGTGCGACAACT
AAAACAGAAGTACAGGAGTTAAAAGATACACCGGCAGTTGTTTCAGCAGATGCTAAAAAT
GCCTTAATTGCTGGCGGCGTTGACGCTACCGATGCTATTGGCGCTGAGTTGGTCAAAATG
TCTTATACCGATAAAAATGGTAAGACAATTGAAGGCGGTTATGCGCTTAAAGCTGGCGAT
AAGTATTACGCCGCAGATTACGATGAAGCGACAGGAGCAATTAAAGCTAAAACCACAAGT
TATACTGCTGCTGACGGCACTACCAAAACAGCGGCTAACCAACTGGGTGGCGTAGACGGT
AAAACCGAAGTCGTTACTATCGACGGTAAAACCTACAATGCCAGCAAAGCCGCTGGTCAT
GATTTCAAAGCACAACCAGAGCTGGCGGAAGCAGCCGCTAAAACCACCGAAAACCCGCTG
CAGAAAATTGATGCCGCGCTGGCGCAGGTGGATGCGCTGCGCTCTGATCTGGGTGCGGTA
CAAAACCGTTTCAACTCTGCTATCACCAACCTGGGCAATACCGTAAACAATCTGTCTGAA
GCGCGTAGCCGTATCGAAGATTCCGACTACGCGACCGAAGTTTCCAACATGTCTCGCGCG
CAGATTTTGCAGCAGGCCGGTACTTCCGTTCTGGCGCAGGCTAACCAGGTCCCGCAGAAC
GTGCTGTCTCTGTTACGTCTCGAGGGCTCCATCGGCGCAGCAAGCATGGAATTTTGTTTT
GATGTATTCAAGGAGCTCAAAGTCCACCATGCCAATGAGAACATCTTCTACTGCCCCATT
GCCATCATGTCAGCTCTAGCCATGGTATACCTGGGTGCAAAAGACAGCACCAGGACACAA
ATAAATAAGGTTGTTCGCTTTGATAAACTTCCAGGATTCGGAGACAGTATTGAAGCTCAG
TGTGGCACATCTGTAAACGTTCACTCTTCACTTAGAGACATCCTCAACCAAATCACCAAA
CCAAATGATGTTTATTCGTTCAGCCTTGCCAGTAGACTTTATGCTGAAGAGAGATACCCA
ATCCTGCCAGAATACTTGCAGTGTGTGAAGGAACTGTATAGAGGAGGCTTGGAACCTATC
AACTTTCAAACAGCTGCAGATCAAGCCAGAGAGCTCATCAATTCCTGGGTAGAAAGTCAG
ACAAATGGAATTATCAGAAATGTCCTTCAGCCAAGCTCCGTGGATTCTCAAACTGCAATG
GTTCTGGTTAATGCCATTGTCTTCAAAGGACTGTGGGAGAAAGCATTTAAGGATGAAGAC
ACACAAGCAATGCCTTTCAGAGTGACTGAGCAAGAAAGCAAACCTGTGCAGATGATGTAC
CAGATTGGTTTATTTAGAGTGGCATCAATGGCTTCTGAGAAAATGAAGATCCTGGAGCTT
CCATTTGCCAGTGGGACAATGAGCATGTTGGTGCTGTTGCCTGATGAAGTCTCAGGCCTT
GAGCAGCTTGAGAGTATAACTAACTTTGAAAAACTGACTGAATGGACCAGTTCTAATGTT
ATGGAAGAGAGGAAGATCAAAGTGTACTTACCTCGCATGAAGATGGAGGAAAAATACAAC
CTCACATCTGTCTTAATGGCTATGGGCATTACTGACGTGTTTAGCTCTTCAGCCAATCTG
TCTGGCATCTCCTCAGCAGAGAGCCTGAAGATATCTCAAGCTGTCCATGCAGCACATGCA
GAAATCAATGAAGCAGGCAGAGAGGTGGTAGGGTCAGCAGAGGCTGGAGTGGATGCTGCA
AGCGTCTCTGAAGAATTTAGGGCTGACCATCCATTCCTCTTCTGTATCAAGCACATCGCA
ACCAACGCCGTTCTCTTCTTTGGCAGATGTGTTTCCCCTTCGAAGCTTGAAGGTAAGCCT
ATCCCTAACCCTCTCCTCGGTCTCGATTCTACGCGTACCGGTCATCATCACCATCACCAT
TGA SEQ ID NO: 317, nucleotide sequence of STF28BGF-1
CTCGGGAGATCTGCACAAGTAATCAACACTAACAGTCT SEQ ID NO: 318, nucleotide sequence of STF28MCR-1
CCATGGGCTAGCAGGATCCACCGGCGCTCCCTGCACGTTCA SEQ ID NO: 319, nucleotide sequence of STF28MCF-2
GGAGCGCCGGTGGATCCTGCTAGCCCATGGACCGAAAACCCG -continued SEQ ID NO: 320, nucleotide sequence of STF28ECR-2
TCTGCAGAATTCACGTAACAGAGACAGCACGTTCTGCGGGACGTCCCGCAGAACGTGCTG
TCTCTGTTACGTGAATTCTGCAGA SEQ ID NO: 312, nucleotide sequence of 3'Forward1
ACTGAGTGCATATGGCACAAGTAATCAACACTAACAG SEQ ID NO: 322, nucleotide sequence of 3'Reverse1
GACTGACTGCTCAGCCTATTAGCAGAGCGGCCGCCACTGTGCTGGATATCTAGAG SEQ ID NO: 323 nucleotide sequence of 5'Forward2
AGTCAGGCCATATGTGCGCACAAGTAATCAACACTAACAGTCTG SEQ ID NO: 324, nucleotide sequence of 5'Reverse2
GACTGACTGCTCAGCCTATTAACGTAACAGAGACAGCACGTTCTGCGGGACCGGTTAG SEQ ID NO: 325, nucleotide sequence of STF2Δ.3'Cys
ATGGCACAAGTAATCAACACTAACAGTCTGTCGCTGCTGACCCAGAATAACCTGAACAAA
TCCCAGTCCGCACTGGGCACCGCTATCGAGCGTCTGTCTTCTGGTCTGCGTATCAACAGC
GCGAAAGACGATGCGGCAGGTCAGGCGATTGCTAACCGTTTCACCGCGAACATCAAAGGT
CTGACTCAGGCTTCCCGTAACGCTAACGACGGTATCTCCATTGCGCAGACCACTGAAGGC
GCGCTGAACGAAATCAACAACAACCTGCAGCGTGTGCGTGAACTGGCGGTTCAGTCTGCT
AACAGCACCAACTCCCAGTCTGACCTCGACTCCATCCAGGCTGAAATCACCCAGCGCCTG
AACGAAATCGACCGTGTATCCGGCCAGACTCAGTTCAACGGCGTGAAAGTCCTGGCGCAG
GACAACACCCTGACCATCCAGGTTGGCGCCAACGACGGTGAAACTATCGATATCGATCTG
AAGCAGATCAACTCTCAGACCCTGGGTCTGGACTCACTGAACGTGCATGGAGCGCCGGTG
GATCCTGCTAGCCCATGGACCGAAAACCCGCTGCAGAAAATTGATGCCGCGCTGGCGCAG
GTGGATGCGCTGCGCTCTGATCTGGGTGCGGTACAAAACCGTTTCAACTCTGCTATCACC SEQ ID NO: 326, nucleotide sequence of 5'Cys.STF2Δ
ATGTGCGCACAAGTAATCAACACTAACAGTCTGTCGCTGCTGACCCAGAATAACCTGAAC
AAATCCCAGTCCGCACTGGGCACCGCTATCGAGCGTCTGTCTTCTGGTCTGCGTATCAAC
AGCGCGAAAGACGATGCGGCAGGTCAGGCGATTGCTAACCGTTTCACCGCGAACATCAAA
GGTCTGACTCAGGCTTCCCGTAACGCTAACGACGGTATCTCCATTGCGCAGACCACTGAA
GGCGCGCTGAACGAAATCAACAACAACCTGCAGCGTGTGCGTGAACTGGCGGTTCAGTCT
GCTAACAGCACCAACTCCCAGTCTGACCTCGACTCCATCCAGGCTGAAATCACCCAGCGC
CTGAACGAAATCGACCGTGTATCCGGCCAGACTCAGTTCAACGGCGTGAAAGTCCTGGCG
CAGGACAACACCCTGACCATCCAGGTTGGCGCCAACGACGGTGAAACTATCGATATCGAT
CTGAAGCAGATCAACTCTCAGACCCTGGGTCTGGACTCACTGAACGTGCATGGAGCGCCG
GTGGATCCTGCTAGCCCATGGACCGAAAACCCGCTGCAGAAAATTGATGCCGCGCTGGCG
CAGGTGGATGCGCTGCGCTCTGATCTGGGTGCGGTACAAAACCGTTTCAACTCTGCTATC
ACCAACCTGGGCAATACCGTAAACAATCTGTCTGAAGCGCGTAGCCGTATCGAAGATTCC
GACTACGCGACCGAAGTTTCCAACATGTCTCGCGCGCAGATTTTGCAGCAGGCCGGTACT
TCCGTTCTGGCGCAGGCTAACCAGGTCCCGCAGAACGTGCTGTCTCTGTTACGT SEQ ID NO: 327, nucleotide sequence of HingeForward1
ACTGAGTGCATATGGCACAAGTAATCAACACTAACAG SEQ ID NO: 328, nucleotide sequence of HingeReverse3
GGTCCATGGGCAAGCAGGATCCACCGGCGCT SEQ ID NO: 329, nucleotide sequence of HingeForward2
AGCGCCGGTGGATCCTGCTTGCCCATGGACC SEQ ID NO: 330, nucleotide sequence of HingeReverse4
GACTGACTGCTCAGCCTATTAACGTAACAGAGACAGCACGTTCTGCGGGACCTGTTAG SEQ ID NO: 331, nucleotide sequence of STF2Δ.HingeCys
ATGGCACAAGTAATCAACACTAACAGTCTGTCGCTGCTGACCCAGAATAACCTGAACAAA
TCCCAGTCCGCACTGGGCACCGCTATCGAGCGTCTGTCTTCTGGTCTGCGTATCAACAGC
GCGAAAGACGATGCGGCAGGTCAGGCGATTGCTAACCGTTTCACCGCGAACATCAAAGGT
CTGACTCAGGCTTCCCGTAACGCTAACGACGGTATCTCCATTGCGCAGACCACTGAAGGC
GCGCTGAACGAAATCAACAACAACCTGCAGCGTGTGCGTGAACTGGCGGTTCAGTCTGCT
AACAGCACCAACTCCCAGTCTGACCTCGACTCCATCCAGGCTGAAATCACCCAGCGCCTG
AACGAAATCGACCGTGTATCCGGCCAGACTCAGTTCAACGGCGTGAAAGTCCTGGCGCAG
GACAACACCCTGACCATCCAGGTTGGCGCCAACGACGGTGAAACTATCGATATCGATCTG
AAGCAGATCAACTCTCAGACCCTGGGTCTGGACTCACTGAACGTGCATGGAGCGCCGGTG
GATCCTGCTAGCCCATGGACCGAAAACCCGCTGCAGAAAATTGATGCCGCGCTGGCGCAG
GTGGATGCGCTGCGCTCTGATCTGGGTGCGGTACAAAACCGTTTCAACTCTGCTATCACC
AACCTGGGCAATACCGTAAACAATCTGTCTGAAGCGCGTAGCCGTATCGAAGATTCCGAC
TACGCGACCGAAGTTTCCAACATGTCTCGCGCGCAGATTTTGCAGCAGGCCGGTACTTCC
GTTCTGGCGCAGGCTAACCAGGTCCCGCAGAACGTGCTGTCTCTGTTACGT SEQ ID NO: 332, amino acid sequence of STF2Δ.3'Cys
MAQVINTNSLSLLTQNNLNKSQSALGTAIERLSSGLRINSAKDDAAGQAIANRFTANIKG
LTQASRNANDGISIAQTTEGALNEINNNLQRVRELAVQSANSTNSQSDLDSIQAEITQRL
NEIDRVSGQTQFNGVKVLAQDNTLTIQVGANDGETIDIDLKQINSQTLGLDSLNVHGAPV
DPASPWTENPLQKIDAALAQVDALRSDLGAVQNRFNSAITNLGNTVNNLSEARSRIEDSD
YATEVSNMSRAQILQQAGTSVLAQANQVPQNVLSLLREFSRYPAQWRPLC -continued

```
SEQ ID NO: 333, amino acid sequence of STF2Δ.HingeCys
MAQVINTNSLSLLTQNNLNKSQSALGTAIERLSSGLRINSAKDDAAGQAIANRFTANIKG
LTQASRNANDGISIAQTTEGALNEINNNLQRVRELAVQSANSTNSQSDLDSIQAEITQRL
NEIDRVSGQTQFNGVKVLAQDNTLTIQVGANDGETIDIDLKQINSQTLGLDSLNVHGAPV
DPACPWTENPLQKIDAALAQVDALRSDLGAVQNRFNSAITNLGNTVNNLSEARSRIEDSD
YATEVSNMSRAQILQQAGTSVLAQANQVPQNVLSLLR

SEQ ID NO: 333, amino acid sequence of STF2Δ.HingeCys
MCAQVINTNSLSLLTQNNLNKSQSALGTAIERLSSGLRINSAKDDAAGQAIANRFTANIK
GLTQASRNANDGISIAQTTEGALNEINNNLQRVRELAVQSANSTNSQSDLDSIQAEITQR
LNEIDRVSGQTQFNGVKVLAQDNTLTIQVGANDGETIDIDLKQINSQTLGLDSLNVHGAP
VDPASPWTENPLQKIDAALAQVDALRSDLGAVQNRFNSAITNLGNTVNNLSEARSRIEDS
DYATEVSNMSRAQILQQAGTSVLAQANQVPQNVLSLLR

SEQ ID NO: 335,
CSKKKKGC

SEQ ID NO: 336,
GAPVDPASPW
```

Example 14

Cloning and Expression of STF2.4×H1C1, a Fusion Protein Comprising Flagellin (TLR5 Agonist) and the Maturational Cleavage Site Peptide of Influenza a Hemagglutinin

Materials and Methods

Construct design: To facilitate cloning of target genes in fusion with flagellin, a cassette plasmid containing a unique BlpI site at the 3' end of the flagellin gene was used (STF2.blp, SEQ ID NO: 340). This cassette was made by introducing a silent mutation (5'-GTGCTGAGCCTGTTACGT-3') at nucleotides 1501 to 1518 of STF2, creating the unique BlpI site in the plasmid cassette, pET24/STF2.blp (SEQ ID NO: 340). Synthetic genes encoding one, two, three and four copies of the maturational cleavage site fragment (H1C1) of influenza A subtype H1 (NIPSIQSRGLFGAIAGFIE; SEQ ID NO: 341) were codon-optimized for *E. coli* expression and obtained from a commercial vendor (DNA2.0 Inc., Menlo Park, Calif.). The synthetic genes were excised with BlpI enzyme and ligated by compatible ends to pET24/STF2.blp which had been treated with BlpI and bacterial alkaline phosphatase (BAP). These constructs were designated as STF2.1×H1C1, STF2.2×H1C1, STF2.3×H1C1 and STF2.4×H1C1 respectively (SEQ ID NO: 342; SEQ ID NO: 343; SEQ ID NO: 344; SEQ ID NO: 345).

Similarly, a fusion gene constructed to contain the H1C1 sequence and flanked by a pair of cysteines to facilitate loop formation of the concatemers was designated as STF2.4×H1C2 (SEQ ID NO: 346). A similar approach was employed to generate a construct harboring four tandem copies of the cleavage fragment of influenza A subtype H5 (RERRRKKRGLFGAIAGFIE; SEQ ID NO: 347) designated as construct STF2.4×H5C1 (SEQ ID NO: 348). The consensus cleavage fragments representing subtypes H3 (NVPEKQTRGIFGAIAGFIE; SEQ ID NO: 349), H2 (NVPQIESRGLFGAIAGFIE; SEQ ID NO: 350) and the B-strain, B/HA (PAKLLKERGFFGAIAGFLE; SEQ ID NO: 351) are thus amenable to this experimental approach as outlined above. In each case, the constructed plasmids were used to transform competent *E. coli* TOP 10 cells and putative recombinants were identified by PCR screening and restriction mapping analysis.

The integrity of the constructs was verified by DNA sequencing and they were used to transform the expression host, BLR3 (DE3) (Novagen, San Diego, Calif.; Cat #69053). Transformants were selected on plates containing kanamycin (50 μg/mL), tetracycline (5 μg/mL) and glucose (0.5%). Colonies were picked and inoculated into 2 ml of LB medium supplemented with 25 μg/ml kanamycin, 12.5 μg/ml tetracycline and 0.5% glucose and grown overnight. Aliquots of these cultures were used to inoculate fresh cultures in the same medium formulation, which were cultured until they reached an $OD_{600}$=0.6, at which time protein expression was induced by the addition of 1 mM IPTG and culturing for 3 hours at 37° C. The cells were harvested and analyzed for protein expression.

SDS-PAGE and Western blot: Protein expression and identity were determined by gel electrophoresis and immunoblot analysis. Cells were harvested by centrifugation and lysed in Laemmli buffer. An aliquot of 10 μl of each lysate was diluted in SDS-PAGE sample buffer with or without 100 mM DTT as a reductant. The samples were boiled for 5 minutes and loaded onto a 10% SDS polyacrylamide gel and electrophoresed (SDS-PAGE). The gel was stained with Coomassie R-250 (Bio-Rad; Hercules, Calif.) to visualize protein bands. For western blot, 0.5 μl/lane cell lysate was electrophoresed and electrotransferred to a PVDF membrane and blocked with 5% (w/v) dry milk. The membrane was probed with anti-flagellin antibody 6H11 (Inotek; Beverly, Mass.) After probing with alkaline phosphatase-conjugated secondary antibodies (Pierce; Rockland, Ill.), protein bands were visualized with an alkaline phosphatase chromogenic substrate (Promega, Madison, Wis.). Bacterial clones which yielded protein bands of the correct molecular weight and reactive with the appropriate antibodies were selected for production of protein for use in biological assays.

Results and Discussion

Cloning and expression of cleavage site constructs: The maturational cleavage site fragment of hemagglutinin precursor is well-conserved across subtypes of influenza strains A and B, and could therefore be a target for the development of a universal vaccine effective against most circulating strains of influenza. A series of plasmids encoding a fusion of the TLR5 ligand with cleavage fragment was generated and expressed in *E. coli* strain BLR(DE3). As assayed by Coomassie blue staining of the SDS-PAGE gel and confirmed by immunoblot assays, the *E. coli* strains harboring the constructs STF2.1×H1C1, STF2.2×H1C1, STF2.3×H1C1, and STF2.4×H1C1 displayed bands that correspond to the predicted molecular weights of 55, 58, 60 and 62 kDa respectively. Similarly, BLR(DE3) strains expressing the constructs STF2.4×H1C2 and STF2.4×H5C1 display recombinant fusion proteins migrating with the apparent molecular weight of 62 Kda and 66 Kda respectively. These data indicate that a fusion of flagellin and cleavage fragment of HA is abundantly expressed in *E. coli.*

Expression and Purification of STF2.4×H1C1, a Fusion Protein Comprising Flagellin (TLR5 Agonist) and the Maturational Cleavage Site Peptide of Influenza a Hemagglutinin

Materials and Methods

Bacterial cell growth and cell lysis: The STF2.4×H1C1 (SEQ ID NO: 345) construct was expressed in the *E. coli* host strain BLR(DE3). The strain was retrieved from a glycerol stock and grown in shake flasks to a final volume of 12 L. Cells were grown in LB medium containing 50 μg/ml kanamycin, 12.5 μg/ml tetracycline, 0.5% dextrose to $OD_{600}$=0.6 and induced with 1 mM IPTG for 3 h at 37° C. The cells were harvested by centrifugation (7000 rpm×7 minutes in a Sorvall RC5C centrifuge) and resuspended in 20 mM Tris-HCl, pH 8.0, 1 μg/ml DNAseI, 1 mM PMSF, protease inhibitor cocktail and 1 mg/ml lysozyme. The cells were then lysed by two passes through a microfluidizer (Microfluidics; Newton, Mass.) at 15,000 psi. The lysate was centrifuged at 45,000 g for one hour in a Beckman Optima L ultracentrifuge (Beckman Coulter; Fullerton, Calif.) to separate the soluble and insoluble fractions.

Purification of STF2.4×H1C1 (SEQ ID NO: 345): After centrifugation, the supernatant fraction was collected and passed through a Q sepharose Fast Flow column (GE/Amersham Biosciences; Piscataway, N.J.). The flow-through fraction from this step was supplemented with Triton X-100 (Sigma; St. Louis, Mo.) to a final concentration of 1% (w/v) and passed through the same Q sepharose column. The flow through fraction was collected again and supplemented with urea to a final concentration of 8 M and citric acid to a final concentration of 20 mM. After adjusting the pH to 3.5 with concentrated HCl, the solution was passed over a Source S column (GE/Amersham Biosciences; Piscataway, N.J.) equilibrated with 20 mM citric acid, pH 3.5.

The column was then washed with 10 column volumes of equilibration buffer supplemented with 1% (w/v) Triton X-100 to remove endotoxin. The protein was then eluted in a 5-column volume linear gradient of 0 to 1 M NaCl in equilibration buffer. The STF2.4×H1C1 was then re-folded by rapid dilution to a final concentration of 0.1 mg/ml protein in refolding buffer [0.1 M Tris-HCl, pH 8.0, 0.1 M NaC, 1% (w/v) glycerol]. The refolded protein was concentrated using a pressurized ultrafiltration stir-cell (Millipore; Billerica, Mass.) and fractionated on a Superdex 200 size-exclusion column (GE/Amersham Biosciences; Piscataway, N.J.).

SDS-PAGE and Western Blot analysis: Protein identity was determined, and 5 purity estimated, by SDS-PAGE. An aliquot of 5 μg of each sample was diluted in SDS-PAGE sample buffer with or without 100 mM DTT as a reductant. The samples were boiled for 5 minutes and loaded onto a 10% SDS polyacrylamide gel (LifeGels; French's Forrest, New South Wales, AUS) and electrophoresed. The gel was stained with Coomassie R-250 (Bio-Rad; Hercules, Calif.) to visualize protein bands. For western blot, 0.5 μg/lane total protein was electrophoresed as described above and then electrotransferred to a PVDF membrane and blocked with 5% (w/v) dry milk before probing with anti-flagellin antibody (Inotek; Beverly, Mass.) or serum from mice immunized with a synthetic, lipidated H1C1 peptide. After probing with alkaline phosphatase-conjugated secondary antibodies (Pierce; Rockland, Ill.), protein bands were visualized with an alkaline phosphatase chromogenic substrate (Promega; Madison, Wis.).

Protein assay: Total protein concentration for all proteins was determined using the Micro BCA (bicinchoninic acid) Assay (Pierce; Rockford Ill.) in the microplate format, using bovine serum albumin as a standard, according to the manufacturer's instructions.

Endotoxin assay: Endotoxin levels for all proteins were determined using the QCL-1000 Quantitative Chromogenic LAL test kit (Cambrex; E. Rutherford, N.J.), following the manufacturer's instructions for the microplate method.

TLR5 bioactivity assay: HEK293 cells constitutively express TLR5, and secrete several soluble factors, including IL-8, in response to TLR5 signaling. Cells were seeded in 96-well microplates (50,000 cells/well), and the STF2.4×H1C1 test protein was added. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce, Rockland, Ill.; #M801E and #M802B) following the manufacturer's instructions. Optical density was measured using a microplate spectrophotometer (FARCyte, GE/Amersham; Piscataway, N.J.).

Results and Discussion

Figure 26:
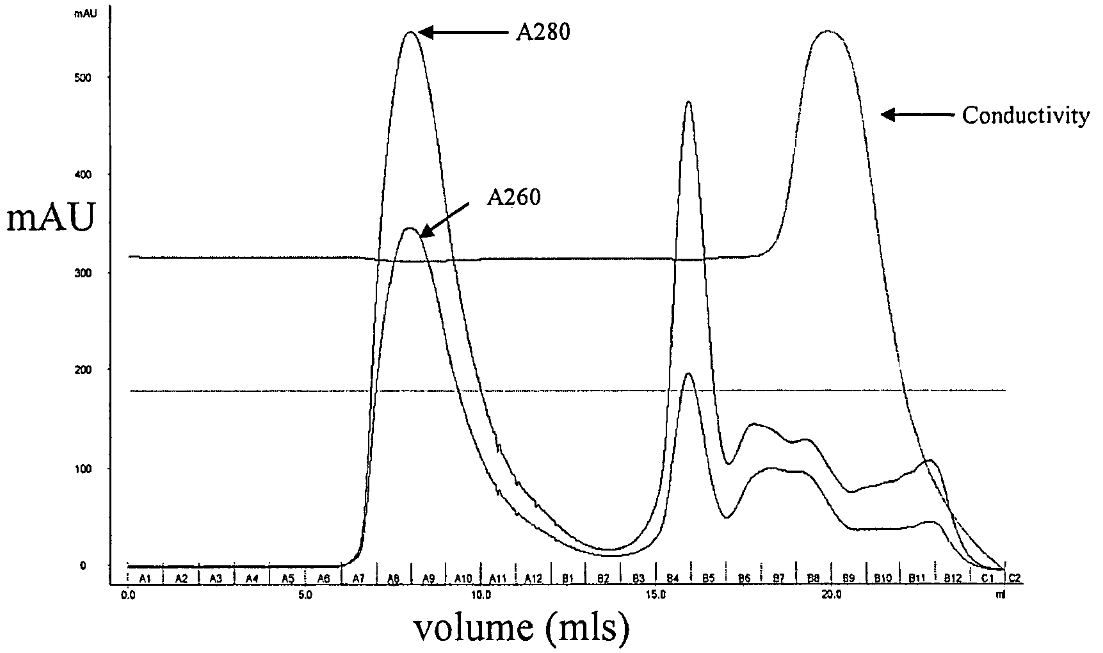
FIG. 26 depicts the S200 chromatogram of STF2.4×H1C1. Void=column void volume; conjugate=elution peak of protein: peptide conjugate; A260, A280 and conductivity are indicated.

The purified and refolded STF2.4×H1C1 protein (SEQ ID NO: 345) was found to be substantially aggregated as the majority of the protein fractionated in the void volume of the Superdex S200 column (FIG. 26). The protein also had poor in vitro TLR5 activity, with an $EC_{50}$ value approximately two orders of magnitude higher than the standard flagellin fusion protein STF2.OVA. The purified protein reacted with serum from mice immunized with a synthetic, lipidated H1C1 peptide.

Expression and Purification of STF2.1×H1C1, a Fusion Protein Comprising Flagellin (TLR5 Agonist) and the Maturational Cleavage Site Peptide of Influenza a Hemagglutinin

Materials and Methods

Bacterial cell growth and cell lysis: The STF2.1×H1C1 (SEQ ID NO: 355) construct was expressed in the *E. coli* host strain BLR(DE3). The strain was retrieved from a glycerol stock and grown in shake flasks to a final volume of 12 L. Cells were grown in LB medium containing 50 μg/ml kanamycin/12.5 μg/ml tetracycline/0.5% dextrose to $OD_{600}$=0.6 and induced with 1 mM IPTG for 3 hours at 37° C. The cells were harvested by centrifugation (7000 rpm×7 minutes in a Sorvall RC5C centrifuge) and resuspended in 20 mM Tris-HCl, pH 8.0, 1 μg/ml DNAseI, 1 mM PMSF, protease inhibitor cocktail and 1 mg/ml lysozyme. The cells were then lysed by two passes through a microfluidizer (Microfluidics; Newton, Mass.) at 15,000 psi. The lysate was centrifuged at 45,000 g for one hour in a Beckman Optima L ultracentrifuge (Beckman Coulter; Fullerton, Calif.) to separate the soluble and insoluble fractions.

Purification of STF2.1×H1C1 (SEQ ID NO: 342): After centrifugation, the supernatant fraction was collected and passed through a Q sepharose Fast Flow column (GE/Amersham Biosciences; Piscataway, N.J.). The flow-through fraction from this step was supplemented with Triton X-100 (Sigma; St. Louis, Mo.) to a final concentration of 1% (w/v) and passed through the same Q sepharose column. The flow-through fraction was collected again and supplemented with urea to a final concentration of −8 M and citric acid to a final concentration of 20 mM. After adjusting the pH to 3.5 with concentrated HCl, the solution was passed over a Source S column (GE/Amersham Biosciences; Piscataway, N.J.) equilibrated with 20 mM citric acid, pH 3.5.

The column was then washed with 10 column volumes of equilibration buffer supplemented with 1% (w/v) Triton X-100 to remove endotoxin. The protein was then eluted in a 5-column volume linear gradient of 0 to 1 M NaCl in equilibration buffer. The STF2.1×H1C1 was re-folded by rapid dilution to a final concentration of 0.1 mg/ml protein in refolding buffer [0.1M Tris-HCl, pH 8.0/0.1M NaCl/1% (w/v) glycerol]. The refolded protein was concentrated using a pressurized ultrafiltration stir-cell (Millipore; Billerica, Mass.) and fractionated on a Superdex 200 size-exclusion column (GE/Amersham Biosciences; Piscataway, N.J.).

SDS-PAGE and western blot analysis: Protein identity was determined, and purity estimated, by SDS-PAGE. An aliquot of 5 μg of each sample was diluted in SDS-PAGE sample buffer with or without 100 mM DTT as a reductant. The samples were boiled for 5 minutes and loaded onto a 10% SDS polyacrylamide gel (LifeGels; French's Forrest, New South Wales, AUS) and electrophoresed. The gel was stained with Coomassie R-250 (Bio-Rad; Hercules, Calif.) to visualize protein bands. For western blot, 0.5 μg/lane total protein was electrophoresed as described above and the gels were then electro-transferred to a PVDF membrane and blocked with 5% (w/v) dry milk before probing with anti-flagellin antibody (Inotek; Beverly, Mass.) or serum from mice immunized with a Pam3Cys.H1C1 peptide (SEQ ID NO: 358). After probing with alkaline phosphatase-conjugated secondary antibodies (Pierce; Rockland, Ill.), protein bands were visualized with an alkaline phosphatase chromogenic substrate (Promega; Madison, Wis.).

Results and Discussion

The purified and refolded STF2.1×H1C1 protein (SEQ ID NO: 342) was found to be monomeric as judged by the elution profile on a Superdex 200 gel filtration column. The majority of the protein was found in the included volume with the major peak eluting at approximately 14 mls. This corresponds very closely with the known elution profile of purified, monomeric flagellin on this column. Almost no protein was seen eluting in the void volume, known to be approximately 7 mls for this column, demonstrating that virtually no aggregates are present.

Immunogenicity and Efficacy of Pam3Cys.H1C1, a Fusion Peptide Comprising Pam3Cys (TLR2 Agonist) and the Maturational Cleavage Site Peptide of Influenza a Hemagglutinin Materials and Methods Peptide design and synthesis: Pam3 (tri-palmoytyl) is the natural ligand for Toll-like Receptor 2 (TLR2), and it is natively expressed as the lipidation motif of bacterial lipoprotein (BLP, SEQ ID NO: 357). Pam3 can be made by chemical synthesis and conjugated to macromolecules such as proteins or coupled to the N-terminus of synthetic peptides using standard peptide synthesis chemistry. This strategy usually involves the synthesis of a peptide of interest concluded by the coupling of Pam3-modified cysteine (Pam3Cys) to the amino terminus to yield the lipopeptide of interest. This approach was used to synthesize a lipidated HA cleavage fragment peptide, Pam3Cys.H1C1 (Pam3Cys-SLWSEENIP-SIQSRGLFGAIAGFIEE, SEQ ID NO: 358).

Mice and immunization: Female BALB/c mice (Jackson Laboratory, Bar Harbor, Me.) were used at the age of 6-8 weeks. Mice were divided into groups of 10 and received inguinal subcutaneous (s.c) immunizations on days 0 and 14 as follows:

8) PBS (phosphate buffered saline).
9) 20 μg of H1C1 native peptide (SEQ ID NO: 358) in saline buffer (10 mM Histidine, 10 mM Tris, 75 mM NaCl, 5% (vol/vol) sucrose, 0.02% (w/v) Polysorbate-80, 0.1 mM EDTA, 0.5% (v/v) ethanol, pH 7.2)
10) 20 μg of Pam3Cys.H1C1 peptide (SEQ ID NO: 358) in saline buffer An additional group of five mice received an experimentally determined sublethal challenge with $8\times10^1$ egg infectious dosages (EID) PR/8/34 and were allowed to convalesce for >21 days. These animals were then used as immune convalescent positive controls during the challenge studies. Mice were bled on days 10 (primary) and 21 (boost), and sera were clarified by clotting and centrifugation and stored at −20° C.

Serum antibody determination: H1C1-specific IgG levels were determined by ELISA. 96-well ELISA plates (Costar (Cat #9018) Corning, N.Y.) were coated overnight at 4° C. with 100 μl/well H1C1 peptide (SEQ ID NO: 358) in PBS (5 μg/ml). Plates were blocked with 2001 l/well of Assay Diluent Buffer (ADB; BD Pharmingen, (Cat#: 555213) (San Diego, Calif.) for one hour at room temperature. The plates were washed three times in PBS+0.05% (v/v) Tween 20 (PBS-T). Dilutions of the sera in ADB were added (100 μl/well) and the plates were incubated overnight at 4° C. The plates were washed three times with PBS-T. HRP-labeled goat anti-mouse IgG antibodies (Jackson Immunochemical, West Grove, Pa. (Cat#: 115-035-146)) diluted in ADB were added (100 μl/well) and the plates were incubated at room temperature for 1 hour. The plates were washed three times with PBS-T. After adding TMB Ultra substrate (Pierce (Cat 34028), Rockford, Ill.)) and monitoring color development, $A_{450}$ was measured on a Tecan Farcyte (Durham, N.C.) microplate spectrophotometer.

Influenza virus challenge of mice. To assess efficacy, mice immunized as described above were challenged on day 28 by intranasal administration of an $LD_{90}$ (dose lethal to 90% of mice) ($8\times10^3$ EID) of influenza A isolate PR/8/34. Animals were monitored daily for 21 days following the challenge for survival, weight loss and clinical presentation. The % weight loss was calculated based on the mean of ((Daily weight (g)/Initial weight (g) day 28)×100) of each individual animal per group. Clinical scores were assigned as follows: 4 pts=healthy, 3 pts=reduced grooming, 2 pts=reduced physical activity and 1 pt=moribund. (Experimental results for clinical scores and weight loss reflect the results based on surviving animals on the day evaluated).

Results and Discussion

Induction of H1C1-specific antibody responses following immunization with Pam3Cys.H1C1: Mice were immunized with native H1C1 peptide (SEQ ID NO: 358) and the same peptide modified by the addition of an amino terminal Pam3Cys residue, to test the hypothesis that linkage of the peptide to a TLR2 ligand would increase its immunogenicity. Immunogenicity was determined by measuring levels of antibodies to native H1C1 (SEQ ID NO: 358) in the sera of the immunized mice. The results show clearly that mice immunized with the Pam3Cys-modified peptide generated higher antibody titers to the immunizing peptide backbone sequence than did mice immunized with the native peptide (SEQ ID NO: 358) (FIG. 27).

Figure 27:
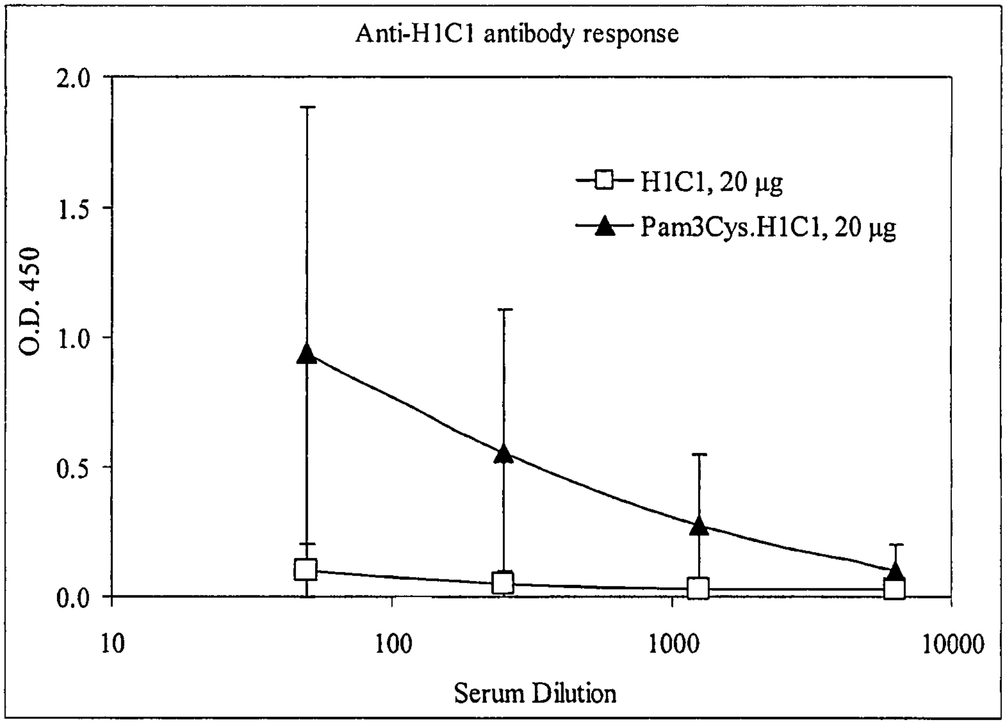
FIG. 27 depicts an anti-H1C1 antibody response of BALB/c mice immunized with native H1C1 peptide or Pam3Cys.H1C1 peptide.
Figure 28:
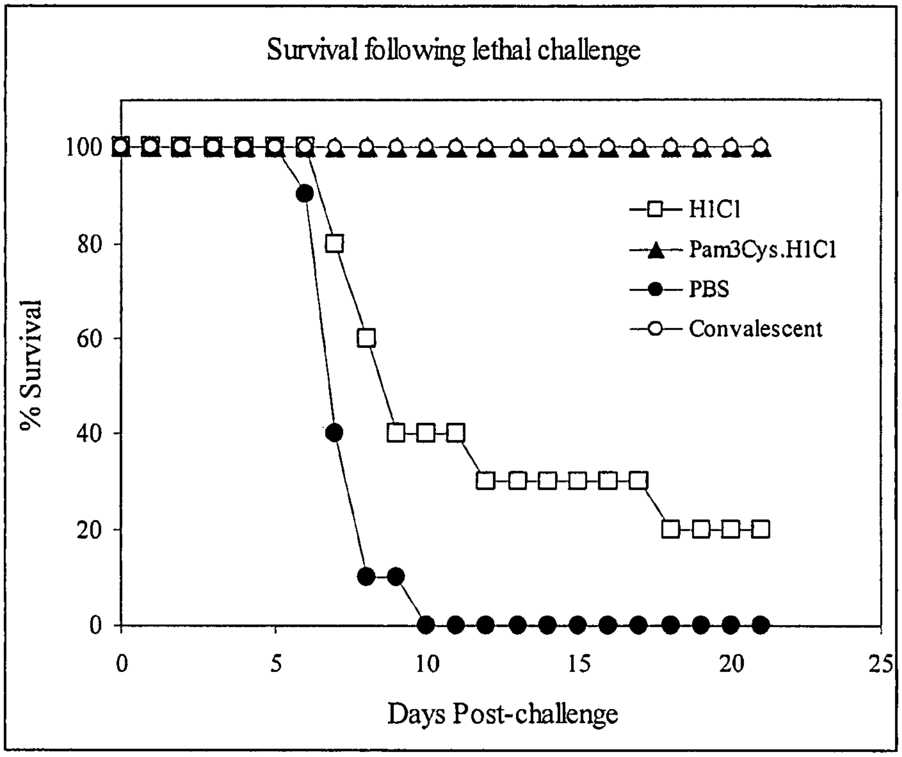
FIG. 28 depicts a survival plot of BALB/c mice immunized with native H1C1 peptide or Pam3Cys.H1C1 peptide then challenged with an $LD_{90}$ of influenza A/Puerto Rico/8/34 virus.

Protection from lethal influenza virus challenge following immunization with Pam3Cys.H1C1 The results in FIG. 27 demonstrated that immunization of mice with Pam3Cys.H1C1 generated an antibody response that recognized native H1C1 peptide. In order to evaluate efficacy, the same mice were challenged on day 28 with an $LD_{90}$ ($8\times10^3$EID) of PR/8/34 virus administered intra-nasally. Mice were monitored daily for 21 days following the challenge for survival, weight loss and clinical presentation. As shown in FIG. 28, PBS-immunized mice died between 6 and 10 days post-challenge, while convalescent mice survived beyond the 21-day observation period. Mice immunized with native H1C1 (SEQ ID NO: 358) began to die by day 6 post-infection at a rate similar to the PBS control mice, althrough 2 of the 10 mice survived beyond the 21-day observation period. In contrast, and similar to the convalescent mice, all mice immunized with Pam3Cys.H1C1 survived beyond the 21-day observation period. Thus, while H1C1 alone is not potently immunogenic (FIG. 27) nor protective (FIG. 28), the same sequence coupled to a TLR2 ligand is both immunogenic and protective.

SEQ ID NO: 340 STF2.blp
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGAGCCTGTTACGT SEQ ID NO: 341 HA maturation cleavage fragment (H1N1)
NIPSIQSRGLFGAIAGFIE SEQ ID NO: 342 STF2.1xH1C1
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH -continued DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLAMEWENIPSIQSRGLFGAIAGFIE

SEQ ID NO: 343 STF2.2xH1C1
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNNSRAQILQQAGTSVLAQANQVPQN
VLSLLA**MEWENIPSIQSRGLFGAIAGFIEEWENIPSIQSRGLFGAIAGFI
E**

SEQ ID NO: 344 STF2.3xH1C1
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADHNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLA**MEWENIPSIQSRGLFGAIAGFIEEWENIPSIQSRGLFGAIAGFI
EEWENIPSIQSRGLFGAIAGFIE**

SEQ ID NO: 345 STF2.4xH1C1
MAQVINTNSLSLLTQNNLNKSQSALGTAIERLSSGLRINSAKDDAAGQAI
ANRFTANIKGLTQASRNANDGISTAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRIEDSDYATEVSNMSRAQILQQAGTSVLAQANQVPQN
VLSLLA**MEWENIPSIQSRGLFGAIAGFIEEWENIPSIQSRGLFGAIAGFI
EEWENIPSIQSRGLFGAIAGFIEEWENIPSIQSRGLFGAIAGFIE**

SEQ ID NO: 346 STF2.4xH1C2
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVLAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRPNSAITN
LGNTVNNLSEARSRIEDSDYATEVSNMSPAQILQQAGTSVLAQANQVPQN
VLSLLA**GCGSEWENIPSIQSRGLFGAIAGFIEEWENIPSIQSRGLFGAIA
GFIEEWENIPSIQSRGLFGAIAGFIEEWENIPSIQSRGLFGAIAGFIESG
C**

SEQ ID NO: 347 HA maturation cleavage fragment (H5N1)
RERRRKKRGLFGAIAGFIE

SEQ ID NO: 348 STF2.4xH5C1
MAQVINTNSLSLLTQNNLNKSQSALGTAIERLSSGLRINSAKDDAAGQAI
ANRFTANIKGLTQASRNANDGISIAQTTEGALNEINNNLQRVRELAVQSA
NSTNSQSDLDSIQAEITQRLNEIDRVSGQTQFNGVKVIAQDNTLTIQVGA
NDGETIDIDLKQINSQTLGLDSLNVQKAYDVKDTAVTTKAYANNGTTLDV
SGLDDAAIKAATGGTNGTASVTGGAVKFDADNNKYFVTIGGFTGADAAKN
GDYEVNVATDGTVTLAAGATKTTMPAGATTKTEVQELKDTPAVVSADAKN
ALIAGGVDATDANGAELVKMSYTDKNGKTIEGGYALKAGDKYYAADYDEA
TGAIKAKTTSYTAADGTTKTAANQLGGVDGKTEVVTIDGKTYNASKAAGH
DFKAQPELAEAAAKTTENPLQKIDAALAQVDALRSDLGAVQNRFNSAITN
LGNTVNNLSEARSRTEDSDYATEVSNMSRAQILQQAGTSVLAQANQVPQN
VLSLLA**EWERERRRKKRGLFGAIAGFIEEWERERRRKKRGLFGAIAGFIE
EWERERPPKKRGLFGAIAGFIEEWERERRPKKRGLFGAIAGFIE**

-continued

SEQ ID NO: 349 HA maturation cleavage fragment (H3N2)
NVPEKQTRGIFGAIAGFIE

SEQ ID NO: 350 HA maturation cleavage fragment (H2N1/H2N2/H2N3/H2N5/H2N8/H2N9)
NVPQIESRGLFGAIAGFIE SEQ ID NO: 351 HA maturation cleavage fragment (B strain)
PAKLLKERGFFGAIAGFLE SEQ ID NO: 352 STF2.4xH1C1
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGTCTCTGTTAGCGATGGAATGGGAGAACATCCCTAGCATCCAATC
TCGCGGCCTGTTTGGCGCTATCGCGGGCTTTATCGAAGAATGGGAGAACA
TCCCGAGCATCCAATCTCGCGGTCTGTTTGGTGCGATCGCTGGTTTCATC
GAGGAGTGGGAGAACATTCCTAGCATTCAAAGCCGTGGCCTGTTCGGCGC
TATTGCAGGTTTTATTGAAGAATGGGAAAATATCCCGTCTATCCAATCCC
GCGGTCTGTTCGGCGCGATCGCAGGTTTCATTGAATAATAAGCTAAGC SEQ ID NO: 353 STF2.3xH1C1
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGAGCCTGTTAGCGATGGAATGGGAAAATATCCCTAGCATCCAATC
TCGCGGTCTGTTCGGTGCTATTGCTGGCTTCATCGAGGAATGGGAGAACA
TCCCATCTATTCAGTCTCGCGGCCTGTTTGGTGCGATCGCGGGTTTTATT
GAGGAATGGGAAAACATTCCAAGCATTCAGTCACGTGGTCTTTTCGGCGC
CATCGCTGGTTTTATCGAATGATAAGCTTAGCCCAAGG SEQ ID NO: 354 STF2.2xH1C1
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGAGCCTGTTAGCGATGGAATGGGAAAATATCCCTAGCATCCAATC
TCGCGGTCTGTTCGGTGCTATTGCTGGCTTCATCGAGGAATGGGAGAACA
TCCCATCTATTCAGTCTCGCGGCCTGTTTGGTGCGATCGCGGGTTTTATT
GAGTGATAAGCTTAGCCCAAGG SEQ ID NO: 355 STF2.1xH1C1
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTPAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGAGCCTGTTAGCGATGGAATGGGAAAATATCCCTAGCATCCAATC
TCGCGGTCTGTTCGGTGCTATTGCTGGCTTCATCGAGTGATAAGCTTAGC
CCAAGG SEQ ID NO: 356 STF2.4xH1C1
ATGGCACAAGTAATCAACACTAACAGTCTGTCGCTGCTGACCCAGAATAA
CCTGAACAAATCCCAGTCCGCACTGGGCACCGCTATCGAGCGTCTGTCTT
CTGGTCTGCGTATCAACAGCGCGAAAGACGATGCGGCAGGTCAGGCGATT -continued

```
GCTAACCGTTTCACCGCGAACATCAAAGGTCTGACTCAGGCTTCCCGTAA
CGCTAACGACGGTATCTCCATTGCGCAGACCACTGAAGGCGCGCTGAACG
AAATCAACAACAACCTGCAGCGTGTGCGTGAACTGGCGGTTCAGTCTGCT
AACAGCACCAACTCCCAGTCTGACCTCGACTCCATCCAGGCTGAAATCAC
CCAGCGCCTGAACGAAATCGACCGTGTATCCGGCCAGACTCAGTTCAACG
GCGTGAAAGTCCTGGCGCAGGACAACACCCTGACCATCCAGGTTGGCGCC
AACGACGGTGAAACTATCGATATCGATCTGAAGCAGATCAACTCTCAGAC
CCTGGGTCTGGACTCACTGAACGTGCAGAAAGCGTATGATGTGAAAGATA
CAGCAGTAACAACGAAAGCTTATGCCAATAATGGTACTACACTGGATGTA
TCGGGTCTTGATGATGCAGCTATTAAAGCGGCTACGGGTGGTACGAATGG
TACGGCTTCTGTAACCGGTGGTGCGGTTAAATTTGACGCAGATAATAACA
AGTACTTTGTTACTATTGGTGGCTTTACTGGTGCTGATGCCGCCAAAAAT
GGCGATTATGAAGTTAACGTTGCTACTGACGGTACAGTAACCCTTGCGGC
TGGCGCAACTAAAACCACAATGCCTGCTGGTGCGACAACTAAAACAGAAG
TACAGGAGTTAAAAGATACACCGGCAGTTGTTTCAGCAGATGCTAAAAAT
GCCTTAATTGCTGGCGGCGTTGACGCTACCGATGCTAATGGCGCTGAGTT
GGTCAAAATGTCTTATACCGATAAAAATGGTAAGACAATTGAAGGCGGTT
ATGCGCTTAAAGCTGGCGATAAGTATTACGCCGCAGATTACGATGAAGCG
ACAGGAGCAATTAAAGCTAAAACTACAAGTTATACTGCTGCTGACGGCAC
TACCAAAACAGCGGCTAACCAACTGGGTGGCGTAGACGGTAAAACCGAAG
TCGTTACTATCGACGGTAAAACCTACAATGCCAGCAAAGCCGCTGGTCAT
GATTTCAAAGCACAACCAGAGCTGGCGGAAGCAGCCGCTAAAACCACCGA
AAACCCGCTGCAGAAAATTGATGCCGCGCTGGCGCAGGTGGATGCGCTGC
GCTCTGATCTGGGTGCGGTACAAAACCGTTTCAACTCTGCTATCACCAAC
CTGGGCAATACCGTAAACAATCTGTCTGAAGCGCGTAGCCGTATCGAAGA
TTCCGACTACGCGACCGAAGTTTCCAACATGTCTCGCGCGCAGATTCTGC
AGCAGGCCGGTACTTCCGTTCTGGCGCAGGCTAACCAGGTCCCGCAGAAC
GTGCTGTCTCTGTTAGCGGGTTGTGGTTCCGAGTGGGAAAATATTCCGTC
TATCCAGAGCCGTGGTCTGTTCGGCGCAATTGCTGGCTTCATTGAAGAAT
GGGAAAACATCCCGTCCATCCAGAGCCGTGGCCTGTTCGGCGCCATTGCT
GGTTTCATCGAGGAATGGGAAAACATTCCGTCCATCCAGTCCCGCGGTCT
GTTTGGCGCTATCGCCGGTTTCATTGAGGAATGGGAAAATATCCCTTCCA
TCCAGTCTCGTGGTCTGTTCGGCGCGATTGCAGGCTTTATCGAATCTGGT
TGCTAATAAGCTAAGC
```

SEQ ID NO: 357 Bacterial lipoprotein of *E. coli*
MKATKLVLGAVILGSTLLAGCSSNAKIDQLSSDVQTLNAKVDQLSNDVNA
NRSDVQAAKDDAARANQRLDNMATKYRK SEQ ID NO: 358 H1C1 native peptide
SLWSEENIPSIQSRGLFGAIAGFIEE

Example 15

Flagellin-M2e Fusion Proteins

M2e is conserved across multiple influenza A subtypes (also referred to herein as "strain"). M2e is at least a portion of the M2 protein, in particular, a 24 amino-terminus (also referred to herein as an "ectodomain") of the M2 protein. The M2 ectodomain is relatively small amino acid sequence (24 amino acids) compared to HA (about 566 amino acids) and NA (about 469 amino acids). The M2e sequence of exemplary avian influenza A isolates differs from that of human isolates, but is highly-conserved among the avian isolates (see, for example, SEQ ID NOS: 544-556, 570 and 573-578). Four tandem copies of M2e fused to the carboxy terminus of a flagellin STF2 (full-length or STF2 hinge region-deleted) were generated. The STF2 without the hinge region is also referred to herein as "STF2Δ."

Construction of Fusion Protein

The carboxy-terminal fusion of the synthetic 4×M2e sequence (4 consecutive 24 amino acid sequences) with STF2 was constructed as follows. The pET24A vector was purchased from Novagen, San Diego, Calif. The strategy employed the Seamless Cloning Kit (Catalog number 214400) from Stratagene (La Jolla, Calif. www.stratagene.com) performed by DNA 2.0 Inc. (Menlo Park, Calif.). The gene encoding the fusion protein was in pDrive 4×M2e G00448 and was used as a PCR template for insert preparation for construction of the C-terminal fusion expression construct with STF2. The synthetic 4×M2e construct pDrive 4×M2e G00448 was used as a template for PCR as outlined in the Seamless Cloning Kit (Catalog number 0214400) from Stratagene (La Jolla, Calif.). The expected product from this amplification includes the 318 bp and the restriction enzyme sites incorporated into the oligonucleotides used to amplify this insert. The procedure was as follows:

PCR conditions

1 μL—20 ng of pDrive 4×M2e G00448

5 μL of 10× cloned Pfu polymerase buffer

1 μL of 40 mM dNTP mix

1 μL—10 pmol of forward primer 4×M2eforbs1

1 μL—10 pmol of reverse primer 4×M2erevwsto

40 μL $ddH_2O$

Immediately before starting the thermal cycling 1 μL of PfuTurbo DNA Polymerase the following were added.

4xM2eforbs1 primer sequence:
5'-CGCTCTTCAMTGAGCTTGCTGACTGAGGTTG (SEQ ID NO: 566)
AGACCCCGATTC 4xM2erevwsto primer sequence:
5'-CGCTCTTCACGCTTATTATCTAGACGGGTCT (SEQ ID NO: 567)
GAGCTATCGTTAGAGCGAG This reaction was cycled as follows on a Thermo Hybaid PxE thermal cycler (Waltham, Mass.).

Initial Cycle

| Temperature | Duration |
|---|---|
| 95° | 3 minutes |
| 65° | 1 minute |
| 72° | 1 minute |

Subsequent Nine Cycles

| Temperature | Duration |
|---|---|
| 95° | 45 seconds |
| 65° | 35 seconds |
| 72° | 1 minute |

At this point the following was added to each reaction.

5 μL of 10× cloned Pfu polymerase buffer

1 μL of 5-methyl dNTP mix

44 μL $ddH_2O$

Subsequently the following thermal cycling was repeated five times.

| Temperature | Duration |
|---|---|
| 95° | 45 seconds |
| 65° | 35 seconds |
| 72° | 1 minute |

The 100 μL product was brought to a volume of 300 μL by the addition of TE buffer. The resulting product was phenol chloroform (Invitrogen Carlsbad, Calif.—Catalog number 15593-031) extracted once and chloroform extracted once. The amplification product was then ethanol precipitated by addition of 30 μL of Sodium acetate buffer pH 5.2 and 750 μL of 100% Ethanol. The DNA pellet washed twice with 300 μL 70% Ethanol allowed to air dry for ten minutes and then resuspended in 50 μL TE buffer.

Amplification of Vector STF2 in pET24.

The previously constructed pET24a/STF2.M2e construct was used as a template for PCR as outlined in the Seamless Cloning Kit (Catalog number 214400) from Stratagene (La Jolla, Calif.). The expected product from this amplification includes the whole of the pET24 plasmid plus the STF2 sequences but does not include the single copy of M2E that exists in this construct. The procedure was as follow:

PCR Conditions

1 μL—40 ng of STF2.M2E pET22-2

5 μL of 10× cloned Pfu polymerase buffer

1 μL of 40 mM dNTP mix

1 μL—10 pmol of primer 4×MECpET24

1 μL—10 pmol of primer 4×M2eC-STF2

40 μL dd$H_2O$

Immediately before starting the thermal cycling the following were added:

```
1 µL of PfuTurbo DNA Polymerase
4xMECpET24 primer sequence:
5'-GCTCTTCAGCGGCTGAGCAATAACTAGCATA (SEQ ID NO: 568)
ACCCCTTGGG

4xM2eC-STF2 primer sequence:
5'-CGCTCTTCACAGACGTAACAGAGACAGCACG (SEQ ID NO: 569)
TTCTGCGG
```

This reaction was cycled as follows on a Thermo Hybaid PxE thermal cycler (Waltham, Mass.).

Initial Cycle

| Temperature | Duration |
|---|---|
| 95° | 3 minutes |
| 65° | 1 minute |
| 72° | 18 minutes |

Subsequent Nine Cycles

| Temperature | Duration |
|---|---|
| 95° | 45 seconds |
| 65° | 35 seconds |
| 72° | 18 minutes |

At this point the following was added to each reaction.

5 μL of 10× cloned Pfu polymerase buffer

1 μL of 5-methyl dNTP mix

44 μL dd$H_2O$

Subsequently the following thermal cycling was repeated five times.

| Temperature | Duration |
|---|---|
| 95° | 45 seconds |
| 65° | 35 seconds |
| 72° | 18 minutes |

The 100 μL product was brought to a volume of 300 μL by the addition of TE buffer. The resulting product was phenol chloroform (Invitrogen Carlsbad, Calif.—Catalog number 15593-031) extracted once and chloroform extracted once. The amplification product was then ethanol precipitated by addition of 30 μL of Sodium acetate buffer pH 5.2 and 750 μL of 100% Ethanol. The DNA pellet washed twice with 300 μL 70% Ethanol allowed to air dry for ten minutes and then resuspended in 50 μL TE buffer.

Digestion and Ligation of Vector and Insert Amplifications

Eam 1104 I digests were set up separately for vector and insert as follows:

30 μL of amplified product after ethanol precipitation

5 μL of 10× Universal buffer (Supplied with Seamless Cloning Kit)

4 μL Eam 1104 I restriction enzyme (Supplied with Seamless Cloning Kit)

11 μL dd$H_2O$

Digests were mixed gently and incubated at 37° C. for one hour and ligation reactions of vector and insert products were prepared as above performed as follows (Reagents supplied with Seamless Cloning Kit):

Ingredients added in order listed:

9 μL dd$H_2O$

5 μL of Eam 1104 I digested 4×M2e amplified insert

5 μL of Eam 1104 I digested STF2.M2E pET22-2 amplified vector

2 μL 10× Ligase buffer

2 μL 10 mM rATP

1 μL T4 DNA Ligase (diluted from stock 1:16)

1 μL Eam 1104 I restriction enzyme

The ligation reactions were mixed gently and incubated for 30 minutes at 37° C. The ligations were then stored on ice until transformed into XL-10 competent cells (Stratagene Catalog number 200314) later than same day.

Transformation of Ligation into XL-10 Competent Cells

Eppendorf tubes were chilled for ten minutes while the XL-10 (Stratagene Catalog number 200314) competent cells thawed on ice.

50 μL of competent cells were aliquoted from the stock tube per ligation.

2 μL of β-mercaptoethanol stock which is provided with the XL-10 cells.

This mixture was incubated for ten minutes on ice gently mixing every 2 minutes. Seamless cloning ligation reaction (4 μl) was added, swirled gently and then incubated on ice for 30 minutes. The tubes were heat shocked for 35 seconds at 42° C. in a water bath. The tubes were incubated on ice for at least two minutes. SOC medium (400 μL) were added to the cells and incubated for one hour at 37° C. with agitation.

Two LB agar kanamycin (50 μg/mL) plates are used to plate 200 μL and 10 μL of the transformed cells and allowed to grow overnight.

Screening of Kanamycin Resistant Clones

Recombinant candidates were grown up for minipreps in Luria Broth containing Kanamycin (25 ug/mL) and extracted using the QIAprep Spin Miniprep Kit (Qiagen Valencia, Calif. Catalog Number 27106). Candidate clones were screened by restriction enzymes (New England Biolabs Beverly, Mass.) and positive clones were grown up in 100 mL of Luria Broth containing kanamycin (25 ug/mL) and extracted using the Qiagen HiSpeed Plasmid Midi Kit (Catalog number 12643). These clones were submitted to GENEWIZ (North Brunswick, N.J.) for sequencing.

Production and Purification of STF2.4×M2e Fusion Protein

STF2.4×M2e in *E. coli* BLR(DE3)pLysS host (Novagen, San Diego, Calif., Catalog #69053) was retrieved from glycerol stock and scaled up to 5 L. Cells were grown in LB medium containing 15 μg/ml Kanamycin and 12.5 μg/ml Tetracycline to $OD_{600}$=0.4 and induced with 1 mM IPTG for 3 h at 37° C. The cells were harvested by centrifugation (7000 rpm×7 minutes in a Sorvall RC5C centrifuge) and resuspended in 2×PBS, 1% glycerol, DNAse, 1 mM PMSF, protease inhibitor cocktail and 1 mg/ml lysozyme. The suspension was passed through a microfluidizer to lyse the cells. The lysate was centrifuged (45,000 g for one hour in a Beckman Optima L ultracentrifuge) to separate the soluble fraction from inclusion bodies. Protein was detected by SDS-PAGE in the soluble and insoluble fractions.

The soluble fraction was applied to Sepharose Q resin in the presence of high salt via batch method to reduce DNA, endotoxin, and other contaminants. The flow through containing the protein of interest was loaded onto 30 ml Q Sepharose column (Amersham Biosciences). Bound protein was eluted using a linear gradient from Buffer A to B. (Buffer A: 100 mM Tris-Cl, pH 8.0. Buffer B: 100 mM Tris-Cl, 1 M NaCl, pH 8.0). Eluted protein was further purified using a 45 ml Source Q column that provided greater resolution needed to resolve contaminating proteins. Bound protein was eluted with a linear gradient from Buffer A to B (Buffer A: 100 mM Tris-Cl, pH 8.0 Buffer B: 100 mM Tris-Cl, 1 M NaCl, pH 8.0).

Final purification of protein was completed using Superdex-200 gel filtration chromatography. The column was developed with 100 mM Tris, 150 mM NaCl and 1% glycerol plus 1% Na-deoxycholate to remove the LPS. Buffer exchange was carried out using overnight dialysis against buffer containing 50 mM Tris, 100 mM NaCl and 1% glycerol was done to remove Na-deoxycholate. Protein concentration was determined by the MicroBCA Protein Assay Reagent Kit (Pierce Biotechnology). Purified preparations of STF2.4× M2e yielded a single band visible with Coomassie stain that migrated with an apparent molecular weight of about 64 kDa on 12% SDS polyacrylamide gels.

Example 16

Expression and Purification of Flagellin (STF2 and STF2Δ) Fusion Protein Constructs Encoding Influenza A M2 Ectodomain Sequences The consensus M2e sequences from several influenza A strains of human and avian origin are depicted in SEQ ID NOS: 544-556, 570 and 573-578. To facilitate the cloning of the M2e sequence, two vector cassettes, pMT/STF2 and pMT/STF2Δ, each containing a multiple cloning site (MCS) were generated (See FIGS. 17A and 17B). To generate pMT/STF2, the 1.5 kb gene encoding full length flagellin of *Salmonella typhimurium* fljb type 2 or STF2, was fused to the Ig binding protein (BIP) secretion signal of pMTBIP/V5-His vector (Invitrogen Corporation, Carlsbad, Calif.) for expression in *Drosophila*. The BiP sequence is included at the 5' end of the construct as a secretion signal for expression in *Drosophila*. A chemically-synthesized 4×M2e gene representing the H1, H2 and H3 consensus sequence, SEQ ID NO: 544, was cloned into the MCS of pMT/STF2 to create pMT/STF2.4×M2e(H1).

A similar strategy prophetically is employed to clone two H5-associated M2e sequences, SLLTEVETPTRNEWECRCSDSSDP (SEQ ID NO: 553) (A/Viet Nam/1203/2004) and SLLTEVETLTRNGWGCRCSDSSDP (SEQ ID NO: 552) (A/Hong Kong/156/97). Codon-optimized chemically synthesized genes containing four tandemly repeated copies of the indicated H5-associated M2e sequence prophetically are cloned into pMT/STF2 to generate STF2.4×M2e(H5VN) and STF2.4×M2e(H5HK), respectively. To generate a construct that contains multiple M2e forms, the heterologous 4×M2e sequence(s) prophetically are inserted into either of the primary constructs.

"Heterologous sequences," as used herein, means sequences from different species. For example, the H1 sequence is a human sequence and the H5 sequence is an avian sequence. Thus, the H1 and H5 sequences are heterologous sequences (e.g., SLLTEVETPTRNEWESRSSDSS-DPLESLLTEVETPTRNEWESRSSDSSDPESSLLT EVETPTRNEWESRSSDSSDPGSSLLTE-VETPTRNEWESRSSDSSDP (SEQ ID NO: 597), encoded by

```
                                    (SEQ ID NO: 598)
tctctgctgactgaagtagaaactccaacgcgtaatgaatgggaatcccg
ttctagcgactcctctgatcctctcgagtccctgctgacggaggttgaaa
ccccgacccgcaacgagtgggaaagccgttcctccgattcctctgatccg
gagagcagcctgctgaccgaggtagaaaccccgacccgtaatgagtggga
atctcgctcctctgattcttctgacccgggatcctctctgctgaccgaag
tggagactccgactcgcaacgaatgggagagccgttcttctgactcctct
gacccg.
```

Primary constructs comprise at least one pathogen-associated molecular pattern (e.g., STF2, STF2Δ) and at least a portion of at least one integral membrane protein (e.g., M2e, such as SEQ ID NOS: 510 and 544). If there is more than one integral membrane in a primary construct, the integral membrane proteins are from the same species.

A heterologous construct includes at least two integral membrane proteins such as H1 (human) and H5 (avian), for example, in SEQ ID NOS: 583 and 584.

To generate pMT/STF2Δ, the hyper-variable region that spans amino acids 170 to 415 of the full-length flagellin gene of SEQ ID NO: 499 was deleted and replaced with a short (10 amino acid) flexible linker (GAPVDPASPW, SEQ ID NO: 594) designed to facilitate interactions of the amino and carboxy terminal sequences necessary for TLR5 signaling. The protein expressed from this construct retains potent TLR5 activity whether expressed alone or in fusion with test antigen. Thus, a second series of M2e constructs prophetically is generated based on pMT/STF2Δ. *Drosophila* Dmel-2 cells (Invitrogen Corporation, Carlsbad, Calif.) grown at room temperature in Schneider's medium supplemented with 10% FBS and antibiotics prophetically is transfected with the constructs described above using Cellfectin reagent (invitrogen) according to the manufacturer's instructions. Twenty-four hours post transfection, cells prophetically is induced with 0.5 mM $CuSO_4$ in medium lacking FBS and incubated for an additional 48 hours. Conditioned media (CM) prophetically is harvested from induced cultures and screened for protein expression by SDS-PAGE and Western blot analyses using anti-flagellin and anti-M2e specific antibodies. The identity, TLR bioactivity of the fusion protein, antigenicity assessed by ELISA and in vivo mouse studies for immunogenicity prophetically is performed.

Example 17

Construction and Expression of Flagellin-Hemaglutinin (HA) Constructs

Figure 42:
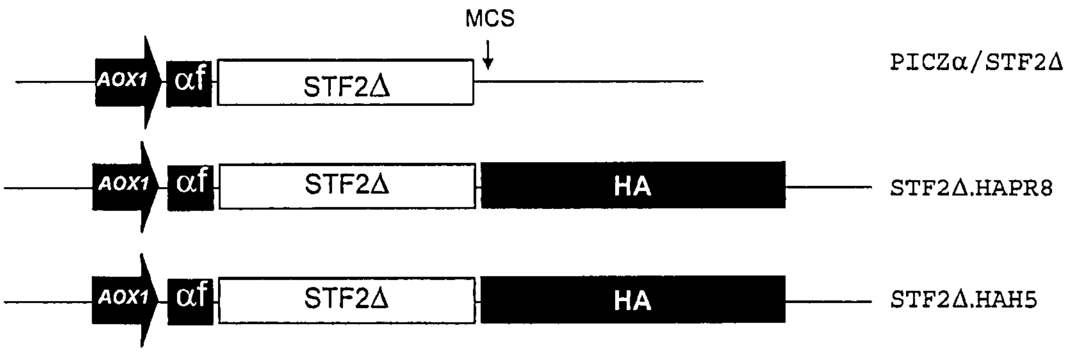
FIG. 42 depicts plasmid constructs designed to express HA of H1 and H5 influenza A virus isolates. AOX1: AOX1 promoter of pPICZα expression vector (Invitrogen Corporation, Carlsbad, Calif.). αf: secretion signal, sequence of yeast. STF2: full-length flagellin of *S. typhimurium*. STF2Δ: hinge region-deleted STF2. MCS: multiple cloning site.
Figure 50:
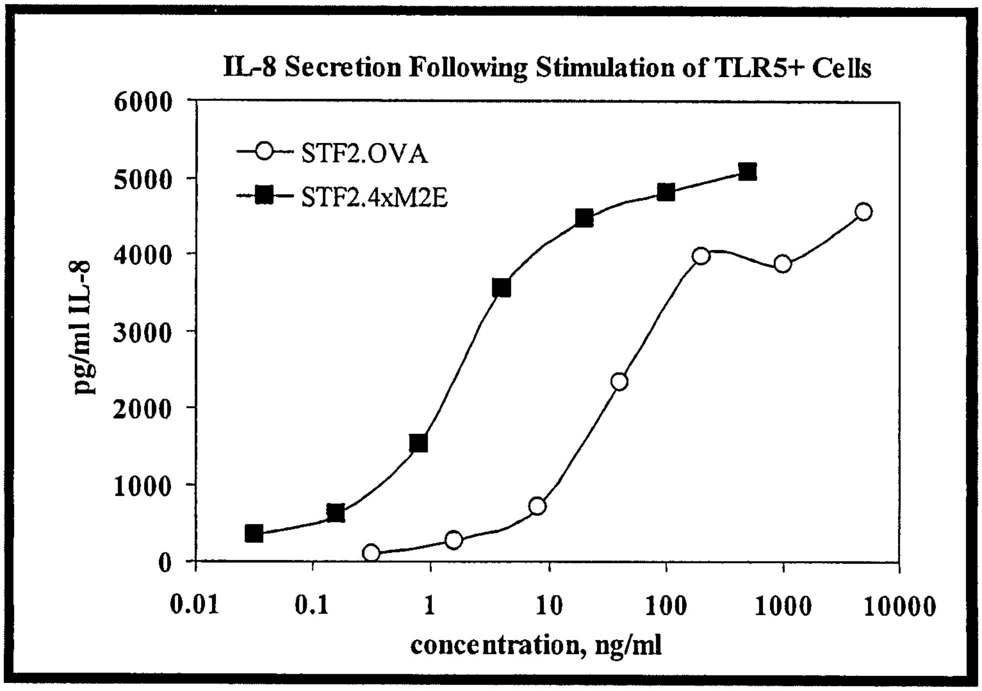
FIG. 50 depicts IL-8 secretion following stimulation of TLR5+ cells.

The gene encoding HA from genomic DNA from the in-house laboratory strain PR8, an attenuated derivative of A/Puerto Rico/8/34 was isolated (SEQ ID NO: 565, encoding SEQ ID NO: 564). The gene was fused to the STF2Δ cassette that has been previously constructed in pPICZΔ generating STF2Δ.HAPR8 (SEQ ID NO: 560, encoding SEQ ID NO: 559) (See FIG. 42). Purified recombinant protein was tested for immunogenicity and efficacy in BALB/c mice. The gene encoding H5N1 of the A/Vietnam/1203/04 strain was custom synthesized and fused to STF2Δ cassette generating STF2Δ.HAH5 (SEQ ID NO: 558, encoding SEQ ID NO: 557). Both human and avian HA constructs were transformed into *Pichia pastoris* strains GS115 and X-33 (Invitrogen Corporation, Carlsbad, Calif.). Selected clones were screened for expression by fractionation on SDS-PAGE gel and staining by Coommassie Blue and Western blot analysis using anti-HA and anti-flagellin antibodies.

Example 18

Generation of a Pam3Cys Fusion Protein

Figure 39:
FIG. 39 depicts a Pam3Cys.M2e fusion protein. The amino acid sequence (SEQ ID NO: 510) of M2e is shown in bold type.

M2e (SEQ ID NO: 544) was chemically coupled to a tri-palmitoylcysteine (Pam3Cys) moiety through the amino terminal serine residue of the peptide. The structure of the fusion protein (Pam3Cys.M2e) is shown in FIG. 39. The chemical name for Pam3Cys.M2e is [Palmitoyl-Cys((RS)-2, 3-di(palmitoyloxy)-propyl)-Ser-Leu-Leu-Thr-Glu-Val-Glu-Thr-Pro-Ile-Arg-Asn-Glu-Trp-Gly-Ser-Arg-Ser-Asn-Asp-Ser-Ser-Asp-Pro-OH acetate salt]. The molecular mass of Pam3Cys.M2e is 3582.3 daltons.

Pam3Cys.M2e was synthesized using a solid phase peptide synthesis methodology based on a well established Fmoc-strategy (Houben-Weyl, 2004. Synthesis of peptides and peptidomimetics, Vol. 22, Georg Thieme Verlag Stuttgart, N.Y.). The synthetic scheme and manufacturing process for Pam3Cys.M2e is diagrammed in the flow chart below. The Pam3Cys.M2e is a fusion protein (chemically linked) and is also referred to herein as a "lipidated peptide."

The first step in the synthesis included solid phase peptide synthesis. The amino acid sequence of Pam3Cys.M2e was assembled on an H-Pro-2-chlorotrityl chloride resin by solid phase peptide synthesis. This resin is highly suitable for the formation of peptides with the Fmoc-strategy. The peptide chain was elongated by successive coupling of the amino acid derivatives. Each coupling step was preceded by an Fmoc-deprotection step and both steps were accompanied by repeated washing of the resin. After coupling of the last amino acid derivative, the final Fmoc-deprotection step was performed. Finally, the peptide resin washed and dried under reduced pressure. During solid phase peptide synthesis color indicator tests were performed for each step to monitor the completion of the Fmoc-cleavage and the subsequent coupling of the amino acid derivatives.

Stage 2 of the synthesis included coupling of Pam3Cys-OH. Pam3Cys-OH was pre-activated with N,N'-dicyclohexyl-carbodiimide (DCCI) in the presence of 1-hydroxybenzotriazole (HOBt). The resulting solution was filtered and added to the peptide resin. At the end of the reaction time the peptide resin washed and dried under reduced pressure. Color indicator tests were performed to control the coupling of Pam3Cys-OH.

Stage 3 of the synthesis included cleavage from the resin including cleavage of the side chain protecting groups. The peptide resin was treated with trifluoroacetic acid (TFA). The product was precipitated from the reaction mixture and lyophilized.

Stage 4 of the synthesis included purification by preparative reverse phase HPLC. The crude material obtained from Stage 3 was purified by preparative HPLC on a reverse phase column using a TFA system. The fractions were collected, checked by analytical HPLC and pooled accordingly. Pooled fractions from the TFA runs were lyophilized.

Stage 5 of the synthesis included precipitation in the presence of EDTA. The purified material from Stage 4 was precipitated from an aqueous solution of EDTA. The product was filtered off and dried under reduced pressure.

Stage 6 of the synthesis included ion exchange chromatography. The last stage of manufacturing Pam3Cys.M2e was the exchange from the trifluoroacetate salt into the acetate salt by ion exchange. The material from Stage 5 was loaded onto an ion exchange column and eluted with acetic acid. Fractions were checked by thin layer chromatography and the combined product-containing fractions were filtered and lyophilized to yield the final product.

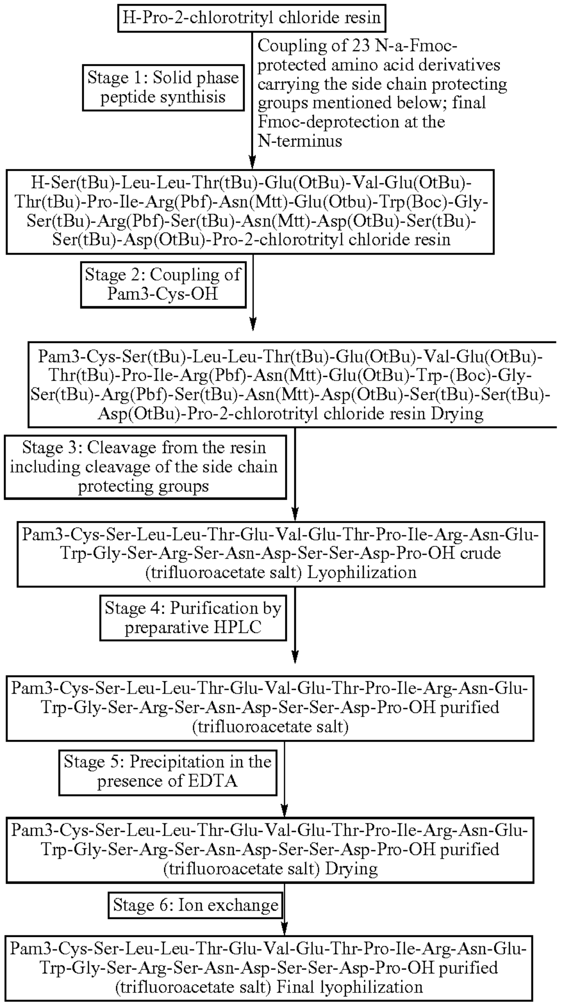

Pam3-Cys-OH = Palmitoyl-Cys((RS)-2,3-di(palmitoyloxy)-propyl)-OH

The purity specification for the Pam3Cys.M2e drug substance was >80% by RP-HPLC. The specification was based on the purity achieved with three non-GMP lots of Pam3Cys.M2e made from the same GMP batch of M2e-peptide intermediate resin. The purity of the three non-GMP lots of Pam3Cys.M2e was 80.2%, 80.3% and 80.8%, for lots D.001.Pam3Cys.M2e, D.002.Pam3Cys.M2e and D.003.Pam3Cys.M2e, respectively.

Example 19

Immunogenicity

Materials and Methods

Synthesis and Purification of Pam3Cys.M2E

Pam3Cys.M2e was prepared by Genemed Synthesis and Bachem using solid phase synthesis methodologies and FMOC chemistry as described above. Mass spectroscopy analysis was used to verify the molecular weight of the final product.

Endotoxin Assay

Endotoxin levels of the STF2.4×M2e and the Pam3Cys.M2e were measured using the QCL-1000 Quantitative Chromogenic LAL test kit (BioWhittaker #50-648U), following the manufacturer's instructions for the microplate method.

TLR5 Bioactivity Assay

HEK293 cells constitutively express TLR5 and secrete several soluble factors, including IL-8, in response to TLR5 signaling. HEK293 cells were seeded in 96-well microplates (50,000 cells/well) and test proteins were added and incubated overnight. The next day, the conditioned medium was harvested, transferred to a clean 96-well microplate and frozen at −20° C. After thawing, the conditioned medium was assayed for the presence of IL-8 in a sandwich ELISA using an anti-human IL-8 matched antibody pair (Pierce, #M801E and #M802B) following the manufacturer's instructions. Optical density was measured using a microplate spectrophotometer (FARCyte, Amersham). Results are reported as pg of IL8 per ml as determined by inclusion of a standard curve for IL8 in the assay.

TLR2Bioactivity Assay

RAW264.7 cells (ATCC) express TLR2 and secrete several soluble factors, including TNFα, in response to TLR2 signaling. RAW264.7 cells were seeded in 96-well microplates (50,000 cells/well), test compounds were added and incubated overnight. The next day, the conditioned medium was harvested, transferred to a clean 96-well microplate and frozen at −20° C. After thawing, the conditioned medium was assayed for the presence of TNFα in a sandwich ELISA using an anti-mouse TNFα matched antibody pair (Pierce) following the manufacturer's instructions. Optical density was measured using a microplate spectrophotometer (FARCyte, Amersham). Results are reported as ng of TNF per ml as determined by reference to a standard curve for TNF included in the assay.

Mouse Immunogenicity

Female BALB/c mice (National Cancer Institute) were used at the age of about 6-8 weeks. Mice were divided into groups of 5 to 10 mice per group, and immunized subcutaneously on each side of the base of the tail on days 0 and 21 with the indicated concentrations of STF2.4×M2e or Pam3Cys.M2e fusion protein. On days 10 (primary) and 28 (boost), individual mice were bled by retro-orbital puncture. Sera were harvested by clotting and centrifugation of the heparin-free blood samples.

Mouse Serum Antibody Determination

M2e-specific IgG levels were determined by ELISA. 96-well ELISA plates were coated overnight at 4° C. with 100 μl/well of a 5 μg/ml solution of the M2e peptide in PBS. Plates were blocked with 200 μl/well of Assay Diluent Buffer (ADB; BD Pharmingen) for one hour at room temperature. The plates were washed three times in PBS containing 0.05% Tween-20 (PBS-T). Dilutions of the sera in ADB were added (100 μl/well) and the plates were incubated overnight at 4° C. The plates were washed three times with PBS-T. Horse radish peroxidase, or HRP-labeled goat anti-mouse IgG antibodies (Jackson Immunochemical) diluted in ADB were added (100 μl/well) and the plates were incubated at room temperature for 1 hour. The plates were washed three times with PBS-T. After adding TMB Ultra substrate (3,3',5,5'-tetramethylbenzidine; Pierce) and monitoring color development, the O.D. 450 was measured on a Tecan Farcyte microspectrophotometer.

Rabbit Immunogenicity

Female and male NZW rabbits (Covance Research Products) were used at the age of about 13-17 weeks. Rabbits were divided into groups of 3 male and 3 female per group, and immunized i.m. on alternating thighs on days 0 and 21 and 42 with the indicated concentrations of Pam3Cys.M2e peptide or STF2.4×M2e fusion protein. Animals were bled on day 1 (prebleed), 14 (primary) and 28 and 42 (boost). Sera were prepared by clotting and centrifugation of samples.

Rabbit Serum Antibody Determination

M2e-specific IgG levels were determined by ELISA. 96-well ELISA plates were coated overnight at about 4° C. with 100 μl/well M2e peptide in PBS (5 μg/ml). Plates were blocked with 200 μl/well of Assay Diluent Buffer (ADB; BD Pharmingen) for one hour at room temperature. The plates were washed three times in PBS-T. Dilutions of the sera in ADB were added (100 μl/well) and the plates were incubated overnight at about 4° C. The plates were washed 3× with PBS-T. Bound IgG was detected using HRP-conjugated goat anti-rabbit IgG (Jackson Immunochemical). The plates were washed three times with PBS-T. After adding TMB Ultra substrate (Pierce) and monitoring color development, O.D. 450 was measured on a Molecular Devices Spectramax microspectrophotometer. Results are reported as the Delta O.D. which is determined by subtracting the O.D. 450 reading for the prebleed of each animal from the O.D. 450 for each animal post-immunization.

BALB/c Mouse Efficacy Model

In a typical experiment, about 5-6 week old female BALB/c mice (10-20 per group) were obtained and allowed to acclimate for one week. Fusion proteins formulated in PBS or other suitable formulation were administered by s.c. injection. Mice were immunized on days 0 and 14. On day 21, sera was harvested by retro-orbital puncture and evaluated for M2e specific IgG by ELISA. Mice were challenged by intranasal administration of 1×LD90 of the well characterized mouse adapted Influenza A strain, A/Puerto Rico/8/34 (H1N1). Mice were monitored daily for 14 days for survival and weight loss. Mice that lost about 30% of their initial body weight were humanely sacrificed, and the day of sacrifice recorded as the day of death. Efficacy data were reported as survival times.

Results

In Vitro Bioactivity

Figure 52:
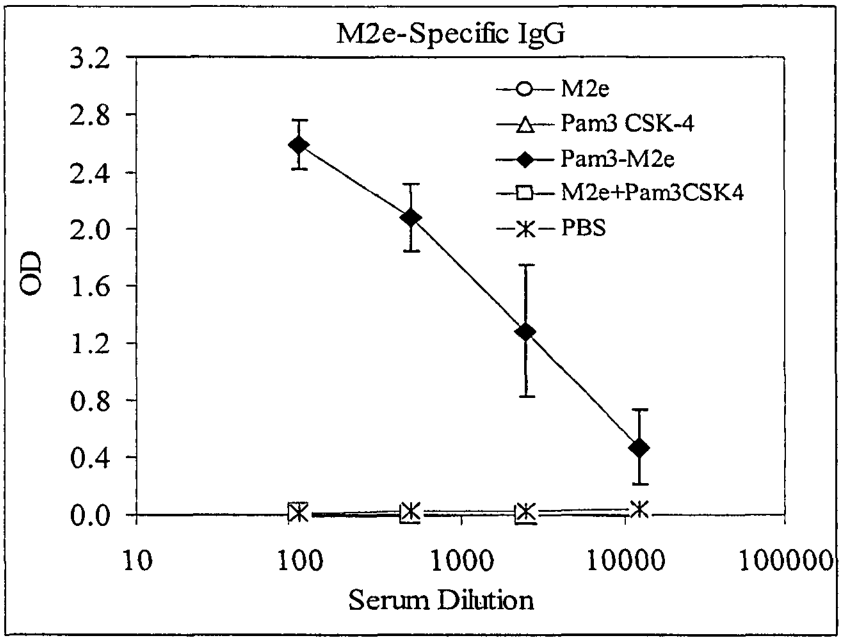
FIG. 52 depicts M2e-specific IgG.

These assays were based on cell lines expressing the relevant TLR and screened for the ability to produce either IL8 or TNF-α in response to TLR triggering. In FIG. 52, the ability of STF2.4×M2e (■) or STF2.OVA(○) to stimulate TLR5 dependent IL8 production was evaluated following the stimulation of TLR5 positive, HEK293 cells. The results indicate that both fusion proteins stimulated IL8 production in a dose dependent manner and that the activity of the PAMP was retained in the context of the fusion.

Figure 51:
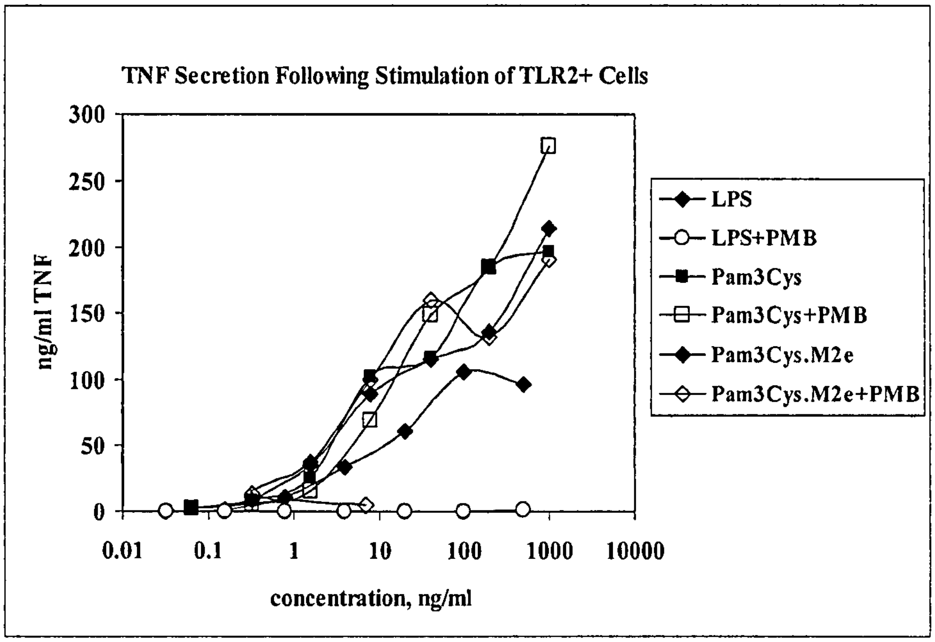
FIG. 51 depicts TNF secretion following stimulation of TLR2+ cells.

TLR2 activity was similarly evaluated for Pam3Cys.M2e following stimulation of TLR2 positive RAW264.7 cells. In FIG. 51, the experimental groups are: the known endotoxin, LPS, as a positive control (♦), LPS plus the inhibitor of endotoxin polymixin B (PMB) as a negative control (○), free Pam3Cys as a positive control for TLR2 signalling (■), free Pam3Cys plus PMB (□), Pam3Cys.M2e (♦) and Pam3Cys.M2e plus PMB (◇). The results showed similar activity profiles for Pam3Cys.M2e and the free TLR2 ligand Pam3Cys. The addition of polymyxin B (PMB) did not reduce its activity, indicating that there is no or low endotoxin contamination.

Physical Linkage of Pamp and Antigen Enhances Immunogenicity

Using mouse models of immunogenicity, chemical coupling of Pam3Cys to M2e enhances the immunogenicity of the M2e antigen as compared to either the M2e peptide delivered alone or the M2e peptide co-delivered with free Pam3Cys. In the experiment shown in FIG. 52, groups of mice were immunized on days 0 and 21 with PBS as a negative control (*), the free TLR2 ligand, Pam3CSK-4 (( ), M2e peptide alone (○), free Pam3CSK-4 mixed with M2e peptide (□), or the fusion of Pam3Cys and M2e referred to as Pam3.M2e (♦). The relevant the molar ratio of M2e peptide delivered was held constant. On day 28, sera were harvested and analyzed for M2e-specific antibody titers by ELISA. The results show that chemical coupling of Pam3Cys to the M2e (Pam3Cys.M2e) generates a detectable serum antibody response to the M2e antigen.

Figure 53:
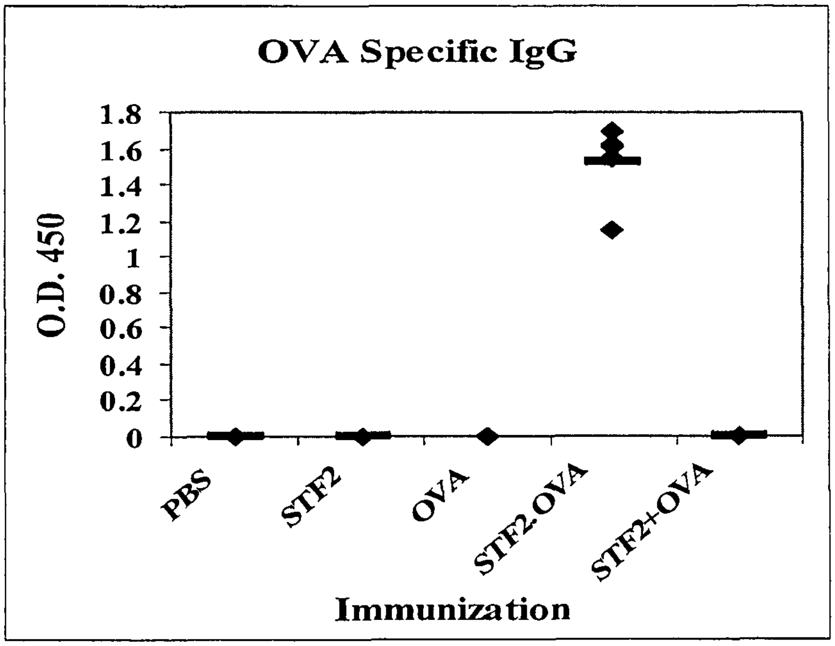
FIG. 53 depicts the OVA-specific IgG.

Physical linkage between the TLR5 ligand STF2 and antigen was demonstrated using the model antigen ovalbumin (OVA). Mice received a single s.c. immunization with STF2, OVA, STF2.OVA fusion protein, STF2+OVA mixture or PBS alone. Dosages were calculated to deliver 12 μg equivalents of STF2 and OVA per group. Seven days later, sera were harvested and OVA-specific antibodies were examined by ELISA. Data shown in FIG. 53 depict IgG1 titers at a 1:100 dilution of the sera. These results demonstrate that physical linkage of the TLR5 ligand and antigen results in optimal immunogenicity in vivo.

Pamp Linked Antigens are More Immunogenic than Conventional Adjuvant

Figure 54:
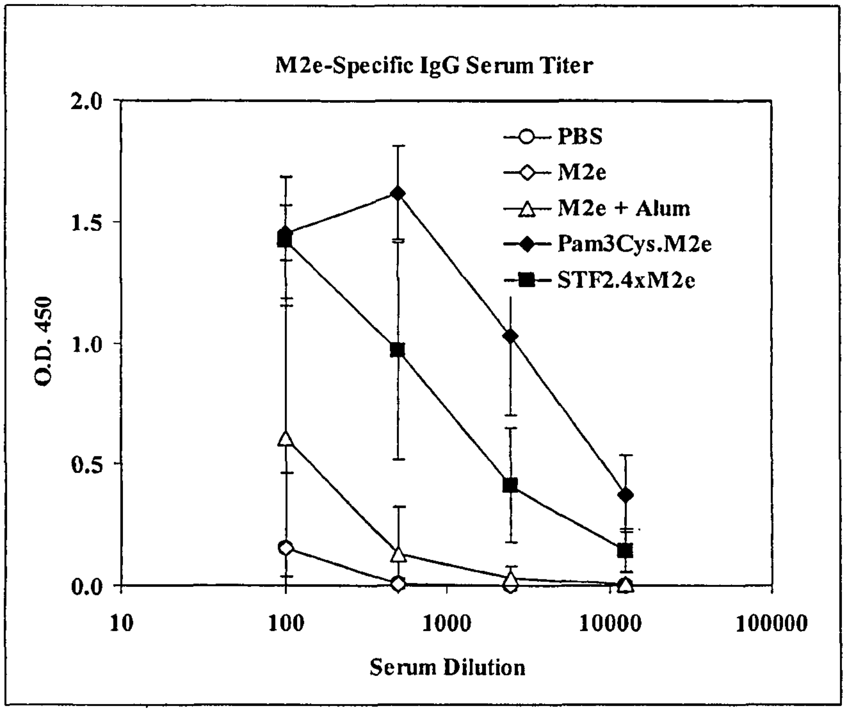
FIG. 54 depicts the M2e-specific-IgG serum titers.

Groups of 5 BALB/c mice were immunized on day 0 and 14 with 30 μg of Pam3Cys.M2e (♦), 22.5 μg of M2e which is the molar equivalent of M2e in 30 μg of Pam3Cys.M2e (◇), 22.5 mg of M2e adsorbed to the conventional adjuvant Alum (□), or 25 mg of the recombinant protein STF2.4×M2e (■). A group receiving PBS was included as a negative control (○). Sera were harvested 7 days post the second dose and M2e specific IgG were evaluated by ELISA. The results shown in FIG. 54 indicate that M2e alone is poorly immunogenic in that it failed to elicit antibody titers above background. The conventional adjuvant Alum provided a modest enhancement in the immune response to M2e. The PAMP linked M2e constructs; however, provided the greatest enhancement in immunogenicity. These results indicate direct linkage of PAMPs with portions of an integral membrane protein of an influenza viral protein can elicit immune responses that are more potent than those elicited by the conventional adjuvant Alum.

Dose and Immunogenicity

Figure 55:
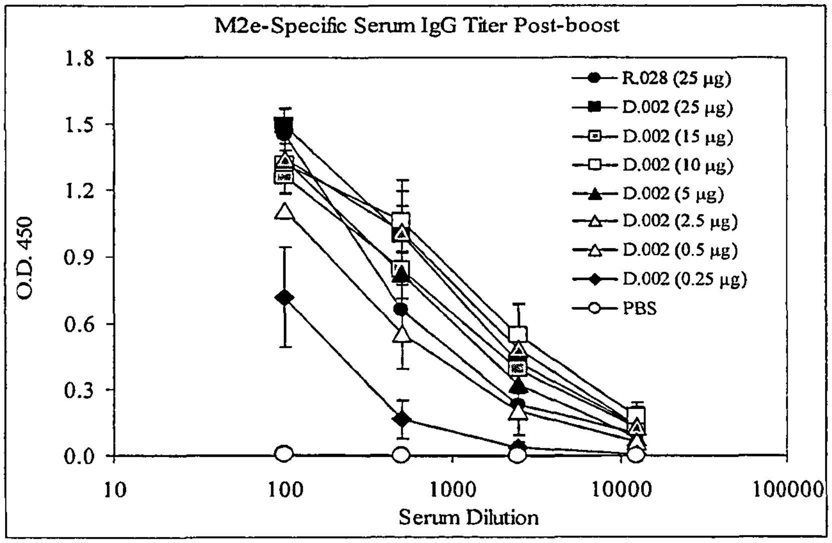
FIG. 55 depicts the M2e-specific serum IgG titer post-boost.

Dose ranging studies were carried out to further assess the potency of Pam3Cys.M2e and STF2.4×M2e. For STF2.4×M2e, BALB/c mice were immunized on day 0 and 14 with dilutions of STF2.4×M2e that ranged from 0.25 to 25 μg of STF2.4×M2e per immunization. The prefix D002 refers to the specific batch of STF2.4×M2e used in this experiment, while R-028 refers to a historical reference batch of STF2.4×M2e used in this experiment. Seven days following the last immunization (Day 21) mice were bled and M2e-specific IgG responses were evaluated by ELISA. The results shown in FIG. 55 demonstrate that immunization with doses as low as 0.25 μg per immunization of STF2.4×M2e induced detectable levels of M2e-specific IgG, with the optimal dose in mice falling in the range of about 2.5 to about 25 μg.

Figure 56:
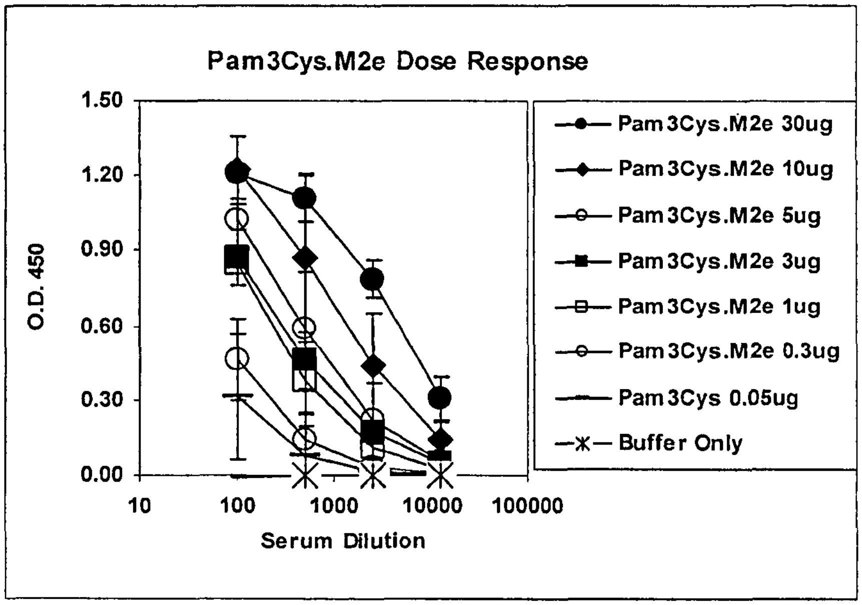
FIG. 56 depicts the Pam3Cys.M2e dose response.

For Pam3Cys.M2e, BALB/c mice were immunized on day 0 and 14 with 0.05 to 30 μg of Pam3Cys.M2e per immunization. Seven days following the last immunization (Day 21) mice were bled and M2e-specific IgG responses were evaluated by ELISA. The results shown in FIG. 56 demonstrate that immunization with concentrations as low as 0.05 μg of Pam3Cys.M2e induced detectable levels of M2e-specific IgG, with the optimal dose for mice in this study of about 30 μg.

Immunogenicity in Multiple Mouse Strains

Figure 57:
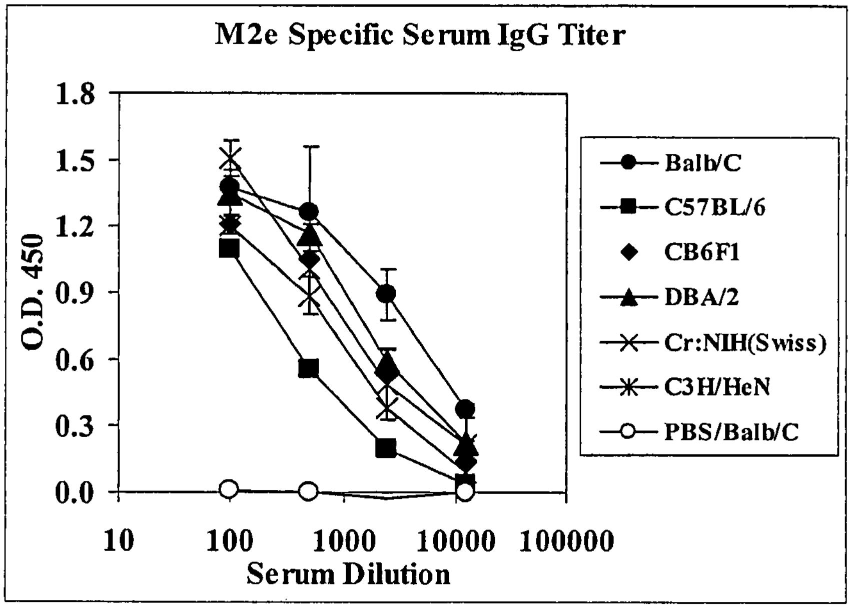
FIG. 57 depicts the M2e-specific serum IgG titer.

The immunogenicity of Pam3Cys.M2e was evaluated in multiple mouse strains including BALB/c (●), C57BL/6 (■), CB6/F1 (♦), DBA/2 (▲), Cr:NIH (Swiss) (X) and C3H/HeN (*). Groups of five for each strain were immunized on day 0 and 14 with 30 μg of Pam3Cys.M2e per immunization. Sera were harvested on day 21 and levels of M2e-specific IgG evaluated by ELISA. All strains exhibited significant levels of M2e-specific IgG indicating that the immunogenicity of Pam3Cys.M2e is not dependent on a particular MHC (FIG. 57).

Immunogenicity in Rabbits

Figure 58:
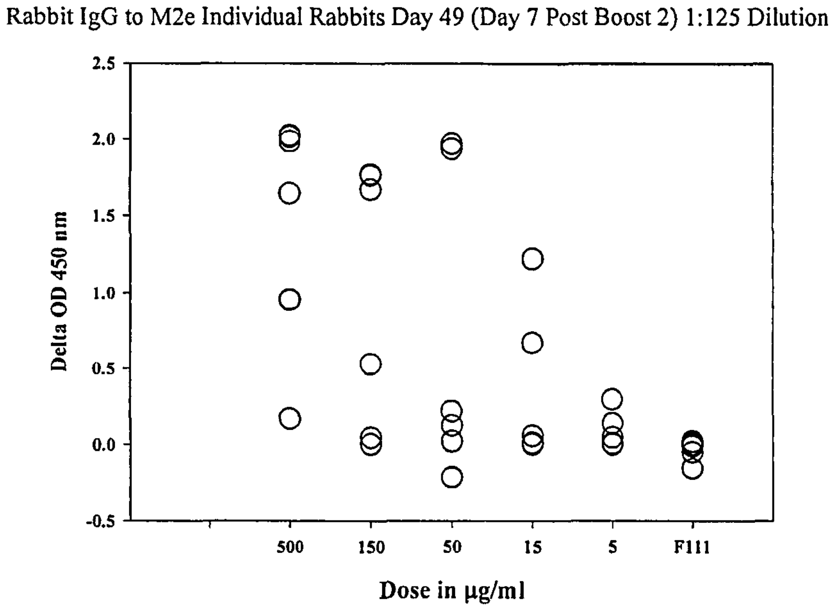
FIG. 58 depicts the rabbit IgG response to M2e.

Studies aimed at evaluating the immunogenicity of Pam3Cys.M2e and STF2.4×M2e in a second species, rabbit, were carried out. In the first study, rabbits (3 females and 3 males/group) were immunized with 500, 150, 50, 15 or 5 μg (i.m.) of Pam3Cys.M2e on day 0, 21 and 42. As a control, an additional group received the formulation buffer F111 (10 mM Tris, 10 mM histidine, 75 mM NaCl, 5% sucrose, 0.02% Polysorbate-80, 0.1 mM EDTA, 0.5% ethanol, 20 mg/mL hydroxypropyl-beta-cyclodextrin, pH 7.2). On day 7 post-boost 2, peripheral blood was obtained and the anti-M2e antibody titers were evaluated by ELISA. The results shown in FIG. 58 depict the individual rabbit antibody titers at a 1:125 dilution of the sera. The data suggest a dose-response relationship between the amount of Pam3Cys.M2e used for prime/boost vaccinations and the level of the antibody titer achieved.

Figure 59:
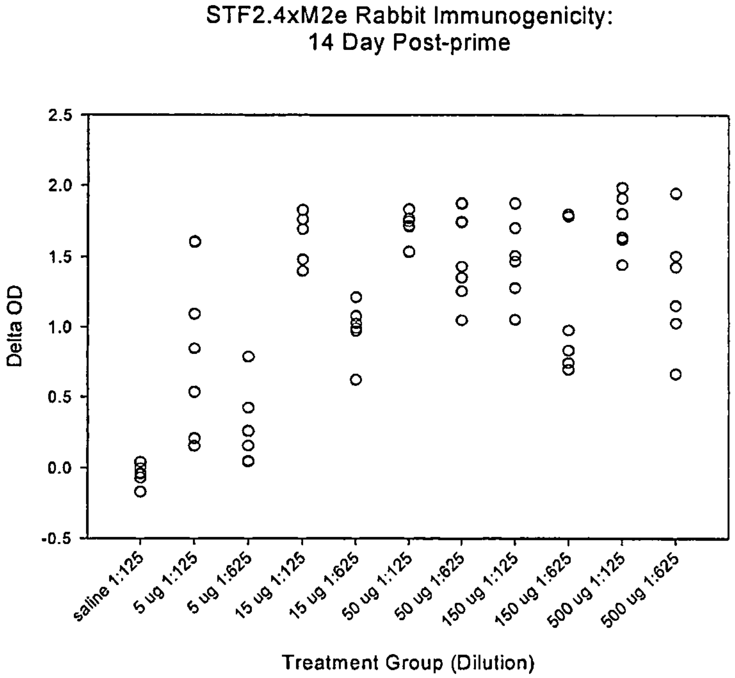
FIG. 59 depicts the immunogenicity of STF2.4×M2e in a rabbit 14 days post-prime.

In the second study, rabbits (3 females and 3 males/group) were immunized with 500, 150, 50, 15 or 5 μg (i.m.) of STF2.4×M2e. As a control, an additional group received saline alone. On day 14 post-immunization, peripheral blood was obtained and the anti-M2e antibody titers were evaluated by ELISA. Notably, significant M2e-specific IgG responses were detectable by day 14 post-prime in all animals immunized (FIG. 59). The results indicate that STF2.4×M2e elicits a rapid and consistent immune response in rabbits.

Efficacy in the Mouse Challenge Model

Figure 60:
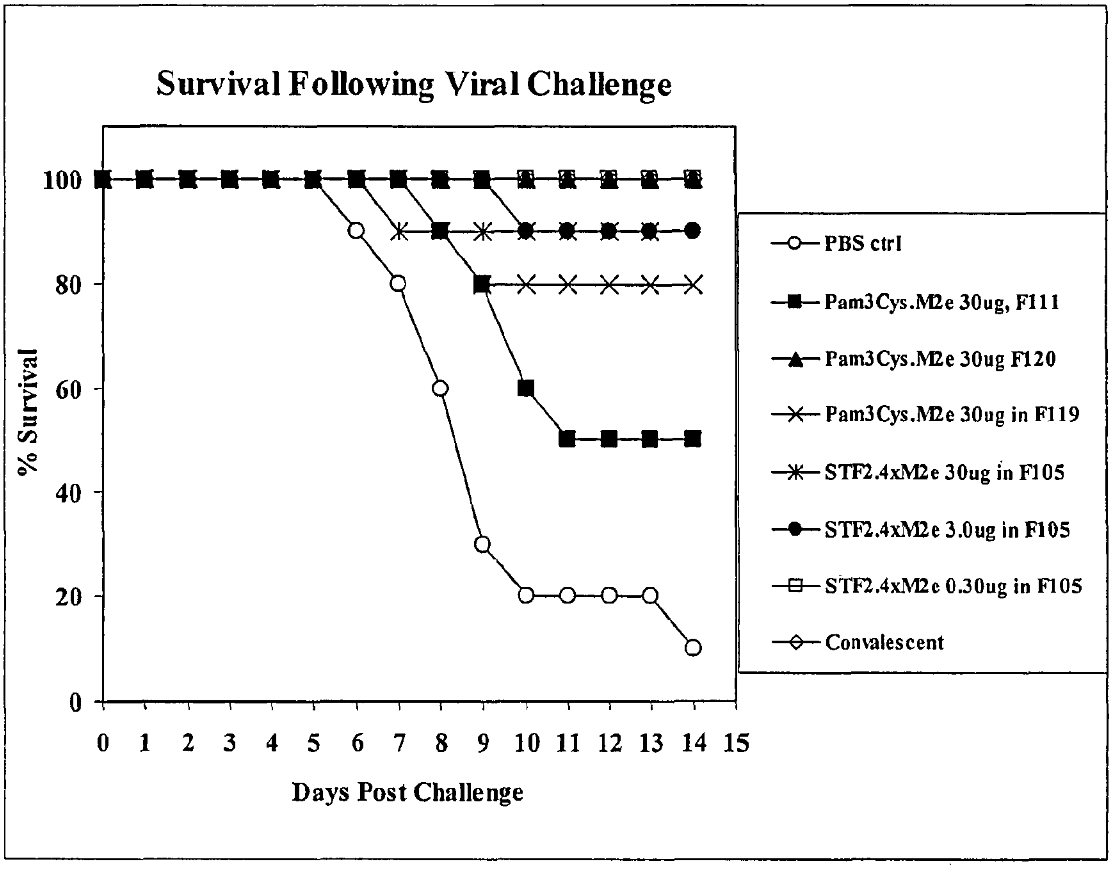
FIG. 60 depicts the survival of BALB1c mice following challenge. Mice were immunized on days 0 and 14 as indicated in the legend and challenged on day 28 by intranasal administration of an $LD_{90}$ of influenza A/Puerto Rico/8/34 virus (Day 0 post-challenge). Mice were monitored for survival for 21 days post-challenge.
Figure 61:
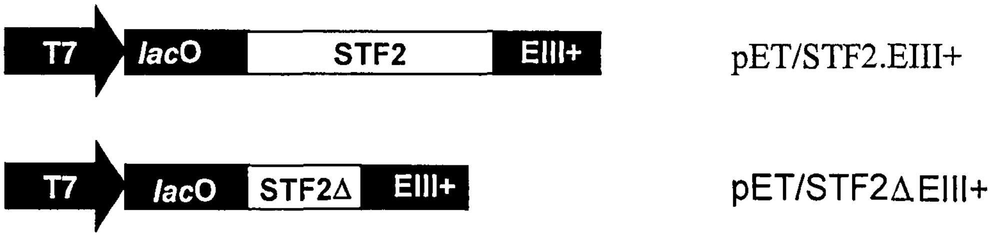
FIG. 61 depicts fusion constructs in a pET24 vector. T7:T7 promoter; lacO: lac operator; STF2: *Salmonella typhimurium* flagellin; STF2Δ=STF2 with the hinge region deleted; $EIII^+$ is domain III of a West Nile envelope protein with 6 amino acids of domain I amino acid.

The efficacy of the Pam3Cys.M2e and STF2.4×M2e was evaluated in BALB/c mice using the well characterized mouse adapted strain, Influenza A/Puerto Rico/8/34 (PR/8) as the challenge virus. Groups of ten mice were immunized s.c. on day 0 and 14 with 30 μg of Pam3Cys.M2e in the formulation buffer F111 (■), 30 μg of Pam3Cys.M2e in the proprietary buffer F120 (10 mM Tris, 10 mM histidine, 10% sucrose, 0.02% Polysorbate-80, 0.1 mM EDTA, 0.5% ethanol, 0.075% docusate sodium, pH 7.2) (▲), 30 μg of Pam3Cys.M2e in the buffer F119 (10 mM Tris, 10 mM histidine, 75 mM NaCl, 5% sucrose, 0.02% Polysorbate-80, 0.1 mM EDTA, 0.5% ethanol, 0.1% docusate sodium, pH 7.2), 30 μg of STF2.4×M2e in the buffer F105 (10 mM Tris, 10 mM histidine, 75 mM NaCl, 5% sucrose, 0.02% Polysorbate-80, 0.1 mM EDTA, 0.5% ethanol, pH 7.2), 3 μg of STF2.4×M2e in buffer F105 (10 mM Tris, 10 mM histidine, 75 mM NaCl, 5% sucrose, 0.02% Polysorbate-80, 0.1 mM EDTA, 0.5% ethanol, pH 7.2) (●) or 0.3 μg of STF2.4×M2e in buffer F105 (□). A group receiving PBS alone was included as a negative control (○), and a convalescent group with immunity to PR/8 following a sublethal challenge with the virus was included as a positive control (◇). On day 28, animals were challenge with an LD90 of the PR/8 challenge stock. Weight loss and survival was followed for 14 days post challenge (FIG. 60).

Animals in the convalescent group which had successfully cleared an earlier non-lethal infection with PR18 demonstrated 100% protection to a subsequent viral challenge. Animals receiving the PBS buffer alone exhibited morbidity beginning on days 7 and 8, with 80% lethality occurring by day 10, while animals immunized with 30 µg of Pam3Cys.M2e in F111 demonstrated enhanced survival, with 50% of mice surviving the challenge. Animals receiving Pam3Cys.M2e in F119 exhibited morbidity beginning on days 8 and 9 with 80% of the mice surviving. Animals receiving Pam3Cys.M2e in buffer F120 (10 mM Tris, 10 mM histidine, 10% sucrose, 0.02% Polysorbate-80, 0.1 mM EDTA, 0.5% ethanol, 0.075% docusate sodium, pH 7.2) or the STF2.4×M2e protein exhibited the mildest disease course with 90 to 100% of the mice in these groups surviving the lethal challenge. These results demonstrate that both Pam3Cys.M2e and STF2.4×M2e can confer protective immunity to a challenge with influenza A in vivo.

Discussion

*Salmonella typhimurium* flagellin (fljB) is a ligand for TLR5. A recombinant protein consisting of full-length flijB (STF2) fused to four tandem repeats of M2e was expressed in *E. coli* and purified to >95% purity with low endotoxin levels. In reporter cell lines, this protein (STF2.4×M2e) triggered IL8 production in a TLR5-dependent fashion. Mice immunized with dilutions of STF2.4×M2e that ranged from 0.25 µg to 25 µg, formulated in the buffer F105 which is without a conventional adjuvant or carrier, mounted a vigorous antibody response. The potency of the recombinant protein was further demonstrated in rabbit immunogenicity studies where animals receiving as little as 5 µg of protein seroconverted after a single dose. The efficacy of the PAMP fusion protein was demonstrated in the mouse challenge model using Influenza A/Puerto Rico/8/34 as the challenge virus. Mice immunized with as little as about 0.3 µg of the protein per dose exhibited mild morbidity with 100% of the mice surviving the challenge.

Synthetic tripalmitoylated peptides mimic the acylated amino terminus of lipidated bacterial proteins and are potent activators of TLR2. In these studies, a tripalmitoylated peptide consisting of three fatty acid chains linked to a cysteine residue and the amino terminus of the Influenza A M2 ectodomain (M2e) was synthesized using standard solid-phase peptide chemistries. This peptide (Pam3Cys.M2e) triggered TNFα production in a TLR2-dependent fashion in reporter cell lines. When used to immunize mice without adjuvant, Pam3Cys.M2e generated an antibody response that was more potent than M2e when mixed with free Pam3CSK-4. Pam3Cys.M2e was also found to be immunogenic in rabbits where a dose response relationship was observed between the amount of Pam3Cys.M2e used for immunization and the antibody titer achieved. The efficacy of the Pam3Cys.M2e peptide in a number of different formulations was evaluated in the mouse challenge model using Influenza A/Puerto Rico/8/34 as the challenge virus. Pam3Cys.M2e formulated in F119 and F120 exhibited the mildest morbidity with about 80 to about 100% of the mice surviving the challenge.

Example 20

Materials and Methods

PCR Amplification and DNA Primers

All PCR amplifications were performed using Pfu Ultra Hotstart PCR Master Mix (Catalog number 600630) from Stratagene (La Jolla, Calif.) according to the manufacturer's recommendations. DNA primers were purchased from Sigma Genosys and are described below.

```
STF28BGF-1:
CTCGGGAGATCTGCACAAGTAATCAACACTAACA  (SEQ ID NO: 644)
GTCT

STF28MCR-1:
CCATGGGCTAGCAGGATCCACCGGCGCTCCCTGC  (SEQ ID NO: 645)
ACGTTCA

STF28MCF-2:
GGAGCGCCGGTGGATCCTGCTAGCCCATGGACCG  (SEQ ID NO: 646)
AAAACCCG

STF28ECR-2:
TCTGCAGAATTCACGTAACAGAGACAGCACGTTC  (SEQ ID NO: 647)
TGCGGGACGTCCCGCAGAACGTGCTGTCTCTGTT
ACGTGAATTCTGCAGA

pET24AR:5
TCCGGCGTAGAGGATCGAGA                (SEQ ID NO: 648)

STF2-E3R3:
CAATTGACCTTCAAGCTTCGAATTGCCCTTACGT  (SEQ ID NO: 649)
AACAGAGACAGCACGTTCTG

AX-E3F3:
AAGCTTGAAGGTCAATTGGAATTCCCTAGGACTA  (SEQ ID NO: 650)
GTATGGAAAAATTGCAGTTGAAG

pET24AF:
GCTTAATGCGCCGCTACAGG                (SEQ ID NO: 651)

5'WNE28:
GCGGCCGCTCATGGAAAAATTGCAGTTGAAGGGA  (SEQ ID NO: 652)
ACAACC

3'WNE28:
CCGCGGTTTGCCAATGCTGCTTCCAGACTTGT    (SEQ ID NO: 653)

NdeI-STF2:
CCGGCATGCCATATGGCACAAGTAATCAACACTA  (SEQ ID NO: 654)
ACAGTCTGTCGCTGC

BlpI-EdIII:
GCATGCTCAGCTTATTAAGGGTTTGCCAATGCTG  (SEQ ID NO: 656)
CTTCCCAGACTTGTG

JE EIII primer:
TACGTGAATTCAGCAGATATCCAGCAC         (SEQ ID NO: 53)
```

Cloning of pET/STF2Δ.EIII

Full length flagellin of *Salmonella typhimurium* fljb (flagellin phase 2) (also referred to herein as "STF2") is encoded by a 1.5 kb gene. A truncated version of the STF2 (STF2Δ, SEQ ID NO: 606, encoded by SEQ ID NO: 607) was generated by deleting the hyper-variable region that spans amino acids 170 to 415 of SEQ ID NO: 604. The deleted region was replaced with a short flexible linker (GAPVD-PASPW, SEQ ID NO: 659) designed to facilitate interactions of the NH$_2$ and COOH termini sequences necessary for TLR5 signaling. To generate this construct, a two-step PCR was used. In the first reaction, STF2.OVA (SEQ ID NO: 755) encoding amino acid sequence SEQ ID NO: 756) served as the DNA template and STF28BGF-1 and STF28MCR-1 were used as primer pairs. In a separate reaction, the same DNA template was combined with primers STF28MCF-2 and STF28ECR-2.

The PCR amplification reactions generated about 500 bp and about 270 bp fragments, respectively. These PCR products were combined in a final PCR reaction using STF28BGF-1 and STF28ECR-2 as primers. The amplified DNA product from this reaction (about 0.77 kb) was digested with BglII and EcoRI restriction enzymes and ligated into pMTBiP/V5-His B (Invitrogen, Carlsbad, Calif.) that had previously been digested with BglII and EcoRI and treated with alkaline phosphatase. An aliquot of the ligation mix was used to transform TOP10 cells (InVitrogen, Carlsbad, Calif.). PCR screening was performed using vector specific primers, pMTFOR (methionine promoter) (CATCTCAGTGCAAC-TAAA, SEQ ID NO: 759) and BGHREV (bovine growth hormone poly A)(TAGAAGGCACAGTCGAGG, SEQ ID NO: 760), to identify several positive clones. All positive clones were further analyzed by restriction mapping analysis and confirmed by DNA sequencing. The resultant construct pMT/STF2Δ was used to generate pMT/STF2Δ.EIII+.

The domain III of the West Nile virus envelope protein of pET/STF2Δ.EIII+ (SEQ ID NOS: 673, 674) was derived from the *Drosophila* expression plasmid pMT/STF2.E. This plasmid contains full-length STF2 (amino acids 1-506, SEQ ID NO: 604) fused to the West Nile Virus envelope protein (amino acids 1-406, SEQ ID NO: 642). The pMT/STF2.E (SEQ ID NO: 761) clone AX-1 was used as a DNA template and 5'WNE28 (SEQ ID NO: 652) and 3'WNE28 (SEQ ID NO: 653) served as primers for PCR amplification. In order to facilitate restriction analysis and subsequent cloning steps, the 5' primer encoded a novel NotI site (New England Biolabls, Beverly, Mass.) and the 3' primer contained a unique SacII site. The amplified EIII+ DNA fragment (345 bp; SEQ ID NO: 781 that encodes amino acids 292-406 of SEQ ID NO: 642) was subcloned into pCR-Blunt II'-TOPO cloning vector (InVitrogen, Carlsbad, Calif.) to generate plasmid TOPOEIII. A stop codon was subsequently introduced downstream of the EIII+ sequence by blunting the SacII and SpeI restriction sites using T4 DNA polymerase.

To generate pMT/STF2Δ.EIII+ (SEQ ID NOS: 673, 674), the EIII+ fragment was isolated from TOPOEIII+ using NotI and BamHI restriction sites and ligated into the NotI and SacII restriction sites in pMT/STF2Δ. The BamHI site of the EIII+ DNA fragment and the SacII site of pMTSTF2Δ were blunted with T4 DNA polymerase prior to ligation. The STF2Δ.EIII+ sequence (SEQ ID NOS: 673, 674) from pMT/STF2Δ.EIII+ was isolated by PCR amplification using the primers NdeI-STF2 and BlpI-EdIII. To generate pET/STF2Δ.EIII+ (SEQ ID NO: 674), the PCR product was digested with NdeI and BlpI and ligated into pET24a plasmid that had been predigested with NdeI and BlpI. The ligation mix was transformed into Mach-1 cells (InVitrogen, Carlsbad, Calif.) and the cells were grown on LB supplemented with 50 μg/ml kanamycin. Several colonies were screened by restriction mapping and were verified by DNA sequencing.

Cloning of pET/STF2.EIII+

The West Nile virus EIII+ sequence of pET/STF2.EIII+ (SEQ ID NOS: 657, 658) was derived from pETSTF2.E (SEQ ID NOS: 761, 762). This *E. coli* expression plasmid contains full-length STF2 (amino acids 1-506) fused to the West Nile Virus envelope protein (amino acids 292-406 of SEQ ID NO: 642, which is SEQ ID NO: 610). In two independent PCR reactions, pET/STF2.E was used as the DNA template. One reaction used the primers pET24AR:5 (SEQ ID NO: 648) and STF2-E3P3: (SEQ ID NO: 649) and the other used AX-E3F3 (SEQ ID NO: 650) and pET24AF (SEQ ID NO: 651). These PCR reactions generated a 1.5 kb fragment that consisted of full-length STF2 and a 340 bp fragment that comprised the EIII domain plus additional amino acids that extended into domain I of the envelope protein. Aliquots of these PCR amplification reactions were combined, and the two products served as templates for a PCR reaction with the external primers pET24AR (SEQ ID NO: 648) and pET24AF (SEQ ID NO: 651). This resulted in the generation of about a 1.8 kb DNA fragment that fused EIII+ sequence (SEQ ID NO: 781, a nucleic acid sequence encoding amino acids 292-406 of SEQ ID NO: 642, which is SEQ ID NO: 610) to STF2. The PCR product was digested with NdeI and BlpI and gel purified and ligated by compatible ends to a pET24a vector that had previously been digested with compatible enzymes and de-phosphorylated. The ligation mix was transformed into Mach-1 cells (InVitrogen, Carlsbad, Calif.) as described for pET/STF2Δ.EIII+. Several colonies were screened by restriction mapping and two clones were verified by DNA sequencing.

Cloning of pET/STF2Δ.JEIII+

A portion of the envelope protein of a Japanese encephalitis virus (JEV) (strain SA-14-14-2 (Jai, L., et al., *Chin Med J* (*Eng*) 116:941-943 (2003)); currently employed in a JEV vaccine encoded by domain III was custom synthesized by DNA 2. Inc (Menlo Park, Calif.). The portion of domain III was excised from the pJ2:G01510 using NotI and Blp I site that flank the insert. The DNA insert was gel isolated and cloned by compatible ends to pET24A/STF2Δ.EIII+ (SEQ ID NOS: 673, 674) that had previously been digested with the appropriate enzymes to release the West Nile virus EIII+ insert. The deleted vector was then gel purified and ligated to an aliquot of JE EIII+. The ligation mix was used to transform TOP-10 cells (InVitrogen, Carlsbad, Calif.) and the cells were grown on LB supplemented with 50 μg/ml kanamycin. Several colonies were screened by restriction mapping and were verified by DNA sequencing.

The resulting construct, pET24A/STF2Δ.JEIII+ (SEQ ID NOS: 608, 609) was BLR (DE3) strain (Novagen) and expression was monitored in several clones using Coomassie Blue staining which was confirmed by Western blot using anti-flagellin antibodies. Using, pET24A/STF2Δ.JEIII+ as the DNA template and the JE EIII+ oligonucleotide as primer (SEQ ID NO: 656) the cysteine residue in the linker region between STF2Δ and JEIII+ was changed to a serine residue using QuikChange Site Directed Mutagenesis Kit (Stratagene, LaJolla, Calif.) according to the manufacturer's instructions. The clone was verified by sequencing and assayed for expression as described for pET24A/STF2Δ.JEIII+ above.

When a cysteine residue in a linker in change to a serine residue the fusion protein in also referred to herein by inclusion of an "s" in the designation of the fusion protein. For example, "STF2Δ.EIII+" includes a cysteine residue in the linker (SEQ ID NO: 674), whereas "STF2Δ.EIIIs+" include a serine residue substituted for the cysteine residue in the linker (SEQ ID NO: 675).

Cloning the EIII Domain of Each Dengue Virus Fused to the C-Terminal End of Flagellin (STF2Δ)

Initially, obtaining biologically active material from the fusion of the entire envelope protein of West Nile virus was difficult, perhaps due to the presence of multiple cysteines residues (12 cysteines) in the envelope protein (see SEQ ID NO: 642). However, when the region encoding domain III (EIII) of the protein was sub-cloned, the fusion protein was abundantly expressed in *E. coli* and was highly efficacious in mice. Although there is an overall sequence dissimilarity among the 4 distinct DEN viruses (Den1, Den2, Den3, Den4, SEQ ID NOS: 763-770, the three-dimensional structures within domain III of the envelope protein are similar among the flaviviruses. This domain in DEN and other flaviviruses encodes the majority of the type-specific contiguous critical/dominant neutralizing epitopes. Domain III of the dengue viruses (Den1, Den2, Den3 and Den4) has been expressed in bacteria and shown to be immunogenic, capable of inducing neutralizing antibodies in experimental animals (Simmons, M., et al., *Am. J. Trop. Med Hyg* 65:159 (2001)). Domain III corresponding to residues about 295 to about 399 (exact numbering depends on the particular DEN virus, for example, of SEQ ID NOS: 763, 765, 767, 769) of the four different DEN viruses have been codon-optimized for expression in *E. coli*. The synthetic gene was amplified by using PCR and sub-cloned into the NotI site of the vector pET/STF2Δ generating pET/STF2Δ.DEN1EIII, pET/STF2Δ.DEN2EIII, pET/STF2Δ.DEN3EIII and pET/STF2Δ.DEN4EIII+ (SEQ ID NOS: 683, 685, 687 and 689).

*E. coli* Production of STF2.EIII+, STF2Δ.EIII+, STF2Δ.EIIIs+ and STF2Δ.JEIII+

Cell cultures (6 L) of BLR(DE3) pLysS that harbor pETSTF2.EIII+ (SEQ ID NOS: 657, 658), pETSTF2Δ.EIII+ (SEQ ID NOS: 673, 674), pETSTF2Δ.EIIIs+ (SEQ ID NOS: 675, 676) or pETSTF2Δ.JEIII+ SEQ ID NOS: 608, 609) were grown in LB medium containing 15 μg/ml kanamycin, 12.5 μg/ml tetracycline and 24 μg/ml chloramphenicol. At an $OD_{600}$ of about 0.6 protein expression was induced with 1 mM IPTG for about 3 h at about 37° C. Following induction, cells were harvested by centrifugation (7000 rpm×7 minutes in a Sorvall RC5C centrifuge) and resuspended in 2×PBS, 1% glycerol, DNAse, 1 mM PMSF, protease inhibitor cocktail and 1 mg/ml lysozyme. The suspension was passed through a microfluidizer to lyse the cells and the lysate was centrifuged (45,000 g for one hour in a Beckman Optima L ultracentrifuge) to separate the soluble fraction from inclusion bodies. Under these growth and induction conditions, STF2.EIII+ was expressed as a soluble protein and STF2Δ.EIII+ (SEQ ID NOS: 673, 674), STF2Δ.EIIIs+ (SEQ ID NOS: 675, 676) and STF2Δ.JEIII+ (SEQ ID NOS: 608, 609) formed inclusion bodies.

Purification of STF2.EIII+

Cell lysate containing soluble STF2.EIII+ (SEQ ID NOS: 657, 658) was applied to Sepharose Q resin (Amersham Biosciences, Piscataway, N.J.) in the presence of 0.5 M NaCl to reduce DNA, endotoxin, and other contaminants. The flow-through fraction was collected and the conductivity adjusted by a 10-fold dilution with buffer A (Buffer A: 100 mM Tris-Cl, pH 8.0). The diluted material was re-loaded onto Q Sepharose and bound protein was eluted with a linear gradient from 20% to 60% Buffer B (Buffer B: 100 mM Tris-Cl, 1 M NaCl, pH 8.0). Fractions containing STF2.EIII+ were pooled and further processed by Superdex-200 gel (SD200) filtration chromatography in the presence of Na-deoxycholate to remove residual endotoxin (running buffer: 1% Na-deoxycholate, 100 mM NaCl, 100 mM Tris-HCl, 1% glycerol, pH 8.0). Following SD200 chromatography, the eluted protein was loaded directly onto Q Sepharose and washed extensively with buffer A to remove detergent. Bound protein was again eluted with a linear gradient from 20% to 60% Buffer B. In one preparation (Batch 057), this step was substituted with a detergent removal procedure using Extract-D detergent removal gel (Pierce Biotechnology, Rockford, Ill.). The purified protein was dialyzed against buffer containing 50 mM Tris, 100 mM NaCl and 1% glycerol and stored at −80° C.

Purification of STF2Δ.EIII+

STF2Δ.EIII+ inclusion bodies were collected by low-speed centrifugation (7000 rpm×7 minutes in a Sorvall RC5C centrifuge) and solubilized with buffer containing 8 M urea, 100 mM Tris-HCl, 5 mM EDTA, pH 8.0. The urea concentration of the solubilized protein was adjusted to 1 M and the sample was loaded onto Q Sepharose. The bound protein was eluted using a linear gradient from 0% to 100% Buffer B. (Buffer A: 100 mM Tris-HCl, 5 mM EDTA, 1 M urea, pH 8.0. Buffer B: 100 mM Tris-Cl, 5 mM EDTA, 1 M NaCl, 1 M urea, pH 8.0). Due to the formation of protein aggregates following elution, the urea concentration of the Q Sepharose material was adjusted to 8 M. The protein was further purified by gel filtration chromatography using SD200. The column was pre-equilibrated with 100 mM Tris-HCl, pH 8.0, 100 mM NaCl, 1% glycerol, 8 M urea plus 1% Na-deoxycholate. The eluted protein was subjected to a second IEX chromatography step using Source Q to remove 1% Na-deoxycholate. Bound protein was eluted with a linear gradient from 20% to 60% Buffer B. (Buffer A: 100 mM Tris-Cl, pH 8.0, 8 M urea, 5 mM EDTA. Buffer B: 100 mM Tris-HCl, pH 8.0, 5 mM EDTA, 8 M urea, 1 M NaCl). Final polishing of the protein was completed by gel filtration chromatography using SD200 (Running Buffer: 100 mM Tris-HCl, pH 8.0, 8 M urea, 100 mM NaCl and 1% glycerol). Reducing agent was added to the SD200 fraction (2.5 mM DTT) and the protein was refolded by step-wise dialysis against decreasing concentrations of urea. The urea concentration was reduced sequentially against buffers that contained 100 mM Tris-HCl, pH 8.0, 100 mM NaCl, 1% glycerol and 6 M, 4 M, 2 M or no urea.

Refolding and Purification of STF2Δ.EIII+ Trimer

STF2Δ.EIII+ (SEQ ID NOS: 673, 674) from urea-solubilized inclusion bodies was efficiently refolded to form trimer product by simple dialysis as described above the trimer (3 of the STFΔ.EIII fusion proteins) was deduced based on molecular weight in SDS-PAGE. Following dialysis, endotoxin was removed by multiple extractions with Triton X-114. The trimer was purified and separated from monomer and aggregates by S200 size exclusion chromatography. The final product migrated as a single band with an apparent molecular weight of about 130 kDa on SDS-PAGE.

Refolding and Purification of STF2Δ.EIII+ Monomer

The monomeric form of STF2Δ.EIII+ (SEQ ID NOS: 673, 674) was produced consistently and efficiently by refolding using rapid dilution, which prevented individual STF2Δ.EIII+ fusion proteins from interacting with one another to form meutimers, such as trimers (supra). STF2Δ.EIII+ solubilized from inclusion bodies in 4M urea was raised to 8M urea without reductant. The protein was then rapidly diluted in Tris/NaCl/glycerol buffer, pH 8.0, to about 0.1 mg/ml and a final urea concentration of 0.1 M at room temperature. The monomer was further purified and separated from aggregates by S200 size exclusion chromatography. The final product migrated as a single band with an apparent molecular weight of about 43 kDa on SDS-PAGE.

Purification of STF2Δ.EIIIs+ (Serine Substitution of the Linker Between STF2Δ and EIII+, SEQ ID NO: 675)

STF2Δ.EIIIs+ (SEQ ID NOS: 675, 676) from solubilized inclusion bodies was refolded using a rapid dilution method similar to that used to refold the STF2Δ.EIII+ monomer. The refolded protein was captured on a butyl sepharose column and eluted while removing most of the endotoxin contamination. Eluate from the butyl sepharose purification was concentrated and put through 4 cycles of Triton X-114 extractions to reduce endotoxin levels down to about <0.1 EU/μg before a final purification step over SD200 gel filtration. The final pooled product migrated as a single band with an apparent molecular weight of about 43 kDa on SDS-PAGE and contained a trace amount of Triton X-114 (about 0.000015%).

Purification of STF2Δ.JEIII+ (SEQ ID NOS: 608, 609)

Protein was isolated from inclusion bodies under denaturing conditions. Inclusion bodies were washed with detergent (0.5% Triton X 100) and solubilized in 8 M urea, resulting in partial purification of the target protein. For endotoxin removal, protein was applied on a Source S cation exchange column at low pH (about 3.5) and eluted with a salt gradient (0 to about 1M NaCl). The protein was refolded using rapid dilution as described for STF2Δ.EIII+ monomer. The protein was then concentrated and further purified using SD200 to separate the monomeric form of the protein from aggregates. The purified material migrated with an apparent molecular weight of about 43 kDa on SDS PAGE and contained acceptable levels of endotoxin (about 0.03 EU/ug).

Fed Batch Production of Fusion Proteins

STF2Δ.EIIIs+ was produced in an aerobic bioreactor using a fed batch process. Three control loops were placed to control pH by acid (2 N HCl) or base (3 N $NH_4OH$) addition, temperature by heating (heating blanket) or cooling (time cycled cooling loop), and dissolved oxygen by compressed air flow (manually controlled), agitation (mixing speed) and $O_2$ flow (timed cycled) in cascade. Cells [BLR(DE3) pLysS that harbor the STF2Δ.EIIIs+ were adapted to and banked in MRSF media (see infra), and frozen in 25% glycerol. Cells were scaled up for the bioreactor by adding 1 mL of banked cells to 1 L of MRSF media and agitating at about 37° C. for about 15.5 to about 16.5 hours. Cells from the scale up process were added in a about 1:10 ratio to MRSF or MRBR synthetic media at about 37° C. and about 0.5 vvm air flow.

The process was run in batch mode at about 37° C. until the cells oxygen consumption was such that the compressed air flow is about 1.5 vvm and the agitation is at the maximum, about 6 hours, when the temperature is dropped to between about 25° C. and about 33° C. The feed can be started before the culture is induced, or up to about 1 and about ½ hours after. The feed rate can be kept constant, or adjusted based on process variables (dissolved oxygen, glucose concentration). The culture was induced with IPTG upon batch glucose exhaustion. The culture was maintained for a minimum of about 2 hours and a maximum of about 20 hours.

| MRBR Media Composition | g/L | Trace Metal Solution 1000x Component | g/L |
|---|---|---|---|
| Glucose | 20 | EDTA, disodium | 5 |
| $KH_2PO_4$ | 2.2 | $FeSO_4(7H_2O)$ | 10 |
| $(NH_4)_2SO_4$ | 4.5 | $ZnSO_4(7H_2O)$ | 2 |
| Citric Acid | 1.0 | $MnSO_4(H_2O)$ | 2 |
| $MgSO_4(7H_20)$ | 1.0 | $CoCl_2(6H_2O)$ | 0.2 |
| $CaCl_2$ | 0.04 | $CuSO_4(5H_2O)$ | 0.1 |
| Trace Metals | 1 ml | $Na_2MoO_4(2H_2O)$ | 0.2 |
| Thiamine HCl | 0.01 | $H_3BO_3$ | 0.1 |
| Antifoam | 0.05 | | |

| MRSF Media Composition | g/L | Feed Media Composition | g/L |
|---|---|---|---|
| Glucose | 10 (20 in bioreacior) | NaCl | 0.5 |
| $KH_2PO_4$ | 7.8 | $FeSO_4(7H_2O)$ | 2 |
| $(NH_4)_2SO4$ | 2.33 | $CaCl_2$ | 3.5 |
| Citric Acid | 1.0 | $MgSO_4(7H_2O)$ | 12 |
| $MgSO_4(7H_20)$ | 1.0 | Thiamine HCl | 1 |
| $CaCl_2$ | 0.04 | Trace Metals | 1 ml |
| Trace Metals | 1 ml | Glucose | 100 |
| Thiamine HCl | 0.01 | | |
| Kanamycin | 0.0075 (shake flask only) | | |

STF2Δ.EIIIs+ was produced as inclusion bodies. Upon harvest, the cells were separated from the conditioned media by centrifugation (Beckman Avanti J-20 XP, JLA 8.1000 rotor, 10 k×g for about 20 minutes at about 4° C.) and resuspended in equal volume of 50 mM Tris, 100 mM NaCl, 1 mM EDTA, pH 8.0. The centrifugation was repeated under the same conditions, with the cells resuspended in a minimum volume of the same buffer. The suspension was passed through a homogenizer (APV-1000) at >10,000 psi for at least two passes.

The solids can be separated and the STF2Δ.EIIIs solubilized by one of three methods; centrifugation, filtration, or fluidized bed chromatography.

Method 1

Solids are separated by centrifugation (Beckman Avanti J-20 XP, JA 20 rotor, 20 k×g for 20 minutes at 4° C.) and resuspended in 50 mM tris, 1 m NaCl, 1 mM EDTA, 1% glycerol, 0.5% Triton X-100, pH 8.0. This process was repeated up to 6 times (total) at increasing speeds and times (to a maximum of about 40 k×g for about 20 minutes). After the final pellet recovery, the pellet was resuspended in 50 mM Tris, 0.1M NaCl, 1 mM EDTA, pH 8.0 and clarified by centrifugation (Beckman Avanti J-20 XP, JA 20 rotor, 40 k×g for about 20 minutes at about 4° C.) The pellet was resuspended and dissolved in 50 mM Tris, 0.1M NaCl, 1 mM EDTA, 4 M urea, pH 8.0. Insolubles were removed by centrifugation (Beckman Avanti J-20 XP, JA 20 rotor, 40 k×g for about 50 minutes at about 4° C.), the supernatant retained for further processing.

After the multiple washes described above, STF2Δ.EIIIs can also be dissolved in 50 mM acetate, 10 mM NaCl, 8M urea, pH about 4.1 to about 5.3 and clarified by centrifugation (Beckman Avanti J-20 XP, JA 20 rotor, 20 k×g for about 20 minutes).

Method 2

After homogenization, the lysate was captured in body feed and STF2Δ.EIIIs+ extracted with urea containing buffer. Body feed is a filter aid designed to trap particles in a cake above a depth filter. The body feed (Advanced Minerals Corporation CelPure 65) is a diatomite (silica powder) with a high surface area and low permeability, retaining <0.2 μm particles. The filter aid was pre-mixed with the lysate and pumped over a depth filter (Ertel 703), building up a cake containing both body feed and lysate particles. The suspension creates a depth filter as the particles settle on the filter pad. A 50 mM Tris, 100 mM NaCl pH 8.0 wash was performed to remove soluble proteins and nucleic acids. A subsequent wash with 50 mM Tris, 100 mM NaCl, 4 M urea, pH 8 solubilizes and removes the STF2Δ.EIIIs from the body feed for further processing.

Method 3

After the cells were initially resuspended in buffer, they were resuspended in sodium chloride and urea containing buffer at pH about 6 to about 8 and homogenized. The lysate was applied on a Streamline CST fluidized bed column (GE Healthcare) where the STF2Δ.EIIIs+ binds to the resin and the particulates flow through. STF2Δ.EIIIs+ may be eluted in low salt conditions at a pH greater than the load pH, in the presence or absence of detergents such as Triton X-100 or polysorbate 80.

SDS-PAGE

Proteins (typically about 5 μg) were diluted in SDS-PAGE sample buffer with and without β-mercaptoethanol. The samples were boiled for 5 minutes and loaded onto a 4-20% SDS polyacrylamide gel. Following electrophoresis, gels were stained with coomassie blue to visualize protein bands.

Endotoxin Assay

Endotoxin levels were measured using the QCL-1000 Quantitative Chromogenic LAL test kit (BioWhittaker #50-648U, Walkersville, Md.), following the manufacturer's instructions for the microplate method.

Protein Assay

Protein concentrations were determined by the MicroBCA Protein Assay Reagent Kit in a 96-well format using BSA as a standard (Pierce Biotechnology, Rockford, Ill.).

TLR5 Bioactivity Assay

HEK293 cells (ATCC, Catalog No. CRL-1573 Manassas, Va.) constitutively express TLR5, and secrete several soluble factors, including IL-8, in response to TLR5 signaling. Cells were seeded in 96-well microplates (about 50,000 cells/well), fusion proteins added and incubated overnight. The next day, the conditioned medium was harvested, transferred to a clean 96-well microplate, and frozen at −20° C. After thawing, the conditioned medium was assayed for the presence of IL-8 in a sandwich ELISA using an anti-human IL-8 matched antibody pair (Pierce, #M801E and #M802B, Rockford, Ill.) following the manufacturer's instructions. Optical density was measured using a microplate spectrophotometer (FARCyte, Amersham Biosciences, Piscataway, N.J.).

Plaque Reduction Neutralization Test (PRNT)

PRNT was performed according to Wang, et al., *J. Immunol.* 167:5273-5277 (2001). Briefly, serum samples were heat inactivated by incubation in a 56° C. water bath for about 30 min and were serially diluted in PBS with 5% gelatin from 1/10 to 1/2560. West Nile virus was diluted in PBS with 5% gelatin so that the final concentration was about 100 PFU/well. Virus was mixed with about 75 μl serum in a 96-well plate at about 37° C. for about 1 h. Aliquots of serum-virus mixture were inoculated onto confluent monolayers of Vero cells in a six-well tissue culture plate. The cells were incubated at about 37° C. for 1 h, and the plates were shaken every 15 min. The agarose overlay was then added. The overlay was prepared by mixing equal volumes of a solution consisting of 100 ml 2×MEM (Life Technologies) with sterile 2% agarose. Both solutions were placed in a 40° C. water bath for 1 h before adding the overlay. The cells were incubated for 4 days at 37° C. in a humidified 5% $CO_2$-air mixture. A second overlay with an additional 4% neutral red was added on day 5. Virus plaques were counted about 12 h later.

Antigenicity of STF2Δ-Fusion Proteins

ELISA plates (96-well) were coated overnight at 4° C. with serial dilutions (100 μl/well) of purified STF2Δ-fusion proteins (SEQ ID NOS: 761, 762, 657, 658, 673, 674) in PBS (about 2 μg/ml). Plates were blocked with 200 μl/well of Assay Diluent Buffer (ADB; BD Pharmingen) for one hour at room temperature. The plates were washed 3× in PBS-Tween, and then incubated with antibodies reactive with flagellin or the E domain of the construct. The expression of flagellin was detected using the mAb 6H11 (Intotek), while the antigenicity of WNV-E was monitored using a panel of mAb (5C5, 7H2, 5H10, 3A3, and 3D9) (Beasley, D. W., et al., *J. Virol.* 76:13097-13100 (2002)) were purchased from Bioreliance (Road Rockville, Md.). Antibodies diluted in ADB (about 100 μl/well) were incubated overnight at 4° C. The plates were washed 3× with PBS-T. HRP-labeled goat anti-mouse IgG antibodies (Jackson Immunochemical, West Grove, Pa.) diluted in ADB were added (100 μl/well) and the plates were incubated at room temperature for 1 hour. The plates were washed 3× with PBS-T. After adding TMB (3,3',5,5'-tetramethylbenzidine) Ultra substrate (Pierce Biotechnology, Rockford, Ill.) and monitoring color development, $A_{450}$ was measured on a Tecan Farcyte microspectrophotometer.

Immunization of Mice

C3H/HeN mice (10 per group) were immunized intraperitoneally or subcutaneously with the indicated concentrations of fusion proteins or synthetic peptides on days 0, 14 and 28. On days 21 and 35, immunized animals were bled by retro-orbital puncture. Sera were harvested by clotting and centrifugation of the heparin-free blood samples. On day 35, mice were challenged with a lethal dose of WNV strain 2741 (Wang, T., et al., *J Immunol* 167:5273-5277 (2001)). Survival was monitored for 21 days post-challenge.

Serum Antibody Determination

West Nile envelope protein specific IgG levels were determined by ELISA. ELISA plates (96-wells) were coated overnight at about 4° C. with 100 μl/well of West Nile E protein mAb 5C5, 7H2, 5H10, 3A3, and 3D9 (Beasley, D. W., et al., *J. Viro.* 76:13097-13100 (2002)) (Bioreliance, Road Rockville, Md.) in PBS at a concentration of 2 μg/ml. Plates were blocked with 200 μl/well of Assay Diluent Buffer (ADB; BD Pharmingen, San Diego Calif.) for one hour at room temperature. The plates were washed 3× in PBS-T. Dilutions of the sera in ADB were added (100 μl/well) and the plates were incubated overnight at 4° C. The plates were washed 3× with PBS-T. HRP-labeled goat anti-mouse IgG antibodies (Jackson Immunochemical, West Grove, Pa.) diluted in ADB were added (100 μl/well) and the plates were incubated at room temperature for 1 hour. The plates were washed 3× with PBS-T. After adding TMB (3,3',5,5'-tetramethylbenzidine) Ultra substrate (Pierce Biotechnology, Rockford, Ill.) and monitoring color development, $A_{450}$ was measured on a Tecan Farcyte microspectrophotometer.

Production of Pam3Cys.WNV001 peptide synthesis

Pam3Cys.WNV001 was synthesized by Bachem Bioscience, Inc. (King of Prussia, Pa.). WNV001 is a 20 amino acid peptide (SEQ ID NO: 771) of the West Nile virus envelope protein chemically coupled to a tri-palmitoylcysteine (Pam3Cys) moiety through the amino terminal serine residue of the peptide. The chemical name for Pam3Cys.WNV001 is [Palmitoyl-Cys((RS)-2,3-di(palmitoyloxy)-propyl)-LTS-GHLKCRVKMEKLQLKGT (SEQ ID NO: 771) acetate salt]. The molecular mass of Pam3Cys.WNV001 is 3163.3 daltons. The peptide was synthesized by Bachem using solid phase synthesis methodologies and FMOC chemistry. The amino acid sequence of Pam3Cys.WNV001 was assembled on an H-Pro-2-chlorotrityl chloride resin by solid phase peptide synthesis. The peptide chain was elongated by successive coupling of the amino acid derivatives. Each coupling step was preceded by an Fmoc-deprotection step and were accompanied by repeated washing of the resin. After coupling of the last amino acid derivative, the final Fmoc-deprotection step was performed. Finally, the peptide resin washed and dried under reduced pressure. During solid phase peptide synthesis color indicator tests were performed for each step to monitor the completion of the Fmoc-cleavage and the subsequent coupling of the amino acid derivatives. To couple Pam3Cys-OH to the elongated peptide, the lipid moiety was pre-activated with N,N'-dicyclohexyl-carbodiimide (DCCI) in the presence of 1-hydroxybenzotriazole (HOBt). The resulting solution was filtered and added to the peptide resin. At the end of the reaction time the peptide resin washed and dried under reduced pressure. Color indicator tests were performed to control the coupling of Pam3Cys-OH. The completed peptide was cleaved from the resin by incubating with trifluoroacetic acid (TFA). The liberated product (crude peptide material) was precipitated from the reaction mixture and lyophilized. The crude product was used for initial immunogenicity studies.

Synthesis of WNV-E Peptide Arrays

Peptide arrays (SEQ ID NOS: 703-754) were synthesized by Sigma Genosys (Woodlands, Tex.).

Results

West Nile Fusion Protein

West Nile virus (WNV) has emerged in recent years in temperate regions of Europe and North America, presenting a threat to public and animal health. The most serious manifestation of WNV infection is fatal encephalitis (inflammation of the brain) in humans and horses, as well as mortality in certain domestic and wild birds. WNV has also been a significant cause of human illness in the United States. The envelope glycoprotein of West Nile (WNV-E) and other flaviviruses may generate neutralizing and protective antibodies, By linking this antigen to a Toll-like Receptor ligand, the compositions, fusion proteins and polypeptides described herein may target appropriate antigen presenting cells without the need for adjuvant or other immune modulator formulations.

As described herein, several strategies have been implemented to facilitate production of West Nile virus envelope (WNV-E) fusion proteins in *E. coli*. One approach is to engineer a smaller WNV-E antigen by fusing domain III (EIII) and, optionally, with amino acids of domain II of the WNV-E protein to full-length STF2 (e.g., STF2.E, STF2.EIII+). Domain III is responsible for virus-host interactions and retains many West Nile virus neutralizing antibody epitopes. It also contains only 2 of the 12 cysteine residues present within the full length envelope protein, making expression in *E. coli* more feasible. A second approach has been to delete the hyper-variable hinge region of flagellin (e.g., STF2Δ) thereby creating a smaller fusion protein (STF2Δ.EIII+) The hyper-variable region of flagellin is not required for TLR5 signaling and its removal may also reduce the immunogenic potential of flagellin. Both STF2.EIII+ and STF2Δ.EIII+ have been expressed in *E. coli* and purified. The purified proteins have been characterized for TLR5 signaling activity in bioassays and for E epitope display in ELISA assays using a panel of WNV-E polyclonal and neutralizing monoclonal antibodies. Results from these studies indicate that STF2Δ.EIII+ has higher PAMP activity and more conformation-sensitive neutralizing WNV-E epitopes than STF2.EIII+.

Purity of STF2.EIII+ and STF2Δ.EIII+

Several lots of STF2.EIII+ and STF2Δ.EIII+ have been produced in *E. coli* and purified (Table 12). STF2.EIII+ was expressed as a soluble protein and purified under non-denaturing conditions using a 4-step process, as described above, that included anion exchange chromatography and gel filtration. Final yields from 6 L cultures ranged from about 0.9 mg to about 3.8 mg and all preparations contained low levels of endotoxin as measured by standard LAL procedures (about <0.1 EU/μg protein, see supra). In contrast, STF-2Δ.EIII+ formed inclusion bodies in *E. coli*, and was purified under denaturing conditions. All chromatography steps used to purify STF2Δ.EIII+ required the use of 8M urea. Following purification, the denatured protein was refolded by step-wise dialysis to allow for gradual urea removal. Refolding was typically carried out at protein concentrations of about 0.3 mg/ml without any loss due to protein precipitation. Two preparations of STF2Δ.EIII+ from a single 6 L culture yielded about 1.2 and about 6.7 mg of protein, both of which had acceptable endotoxin levels. As expected, purified STF2.EIII+ and STF2Δ.EIII+ migrated on SDS PAGE under reducing conditions as about 65 kDa and about 43 kDa proteins, respectively. Notably, STF2Δ.EIII+ migrated slightly faster under non-reducing conditions. This altered migration may be due to disulfide bond formation involving the two cysteines residues in domain III of the envelope protein. As well, a larger species of STF2Δ.EIII+ was detected by Western blot analysis whose molecular weight is consistent with a trimer form of the protein ("(STF2Δ.EIII+)x3 or 3 units of STF2Δ.EIII+").

TABLE 11

Endotoxin levels and TLR-5 activity for STF2.EIII+ (SEQ ID NO: 658) and STF2Δ.EIII+ (SEQ ID NO: 674) fusion proteins.

| Batch Number | Protein | Yield (mg) | Endotoxin Levels (EU/μg) | TLR-5 $EC_{50}$ |
|---|---|---|---|---|
| 052 | STF2.EIII+ | 3.8 | 0.03 | >5000.00 ng/ml |
| 054 | STF2.EIII+ | 0.9 | 0.02 | 1195.00 ng/ml |
| 057 | STF2.EIII+ | 1.6 | 0.07 | 197.92 ng/ml |
| 044 | STF2Δ.EIII+ | 1.2 | 0.07 | 1.13 ng/ml |
| 045 | STF2Δ.EIII+ | 6.7 | 0.07 | 4.34 ng/ml |

TLR5 Activity in the HEK293 IL-8 Assay

Figure 62A:
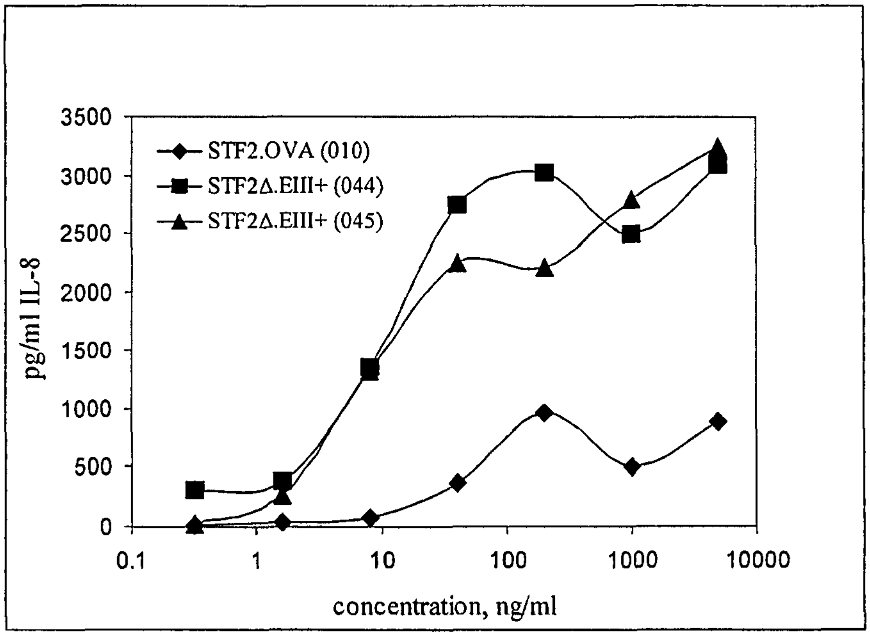
FIGS. 62A and 62B depict TLR5 bioactivity of STF2.EIII+ (SEQ ID NOS: 657, 658) and STF2ΔEIII+ (SEQ ID NOS: 673, 674) fusion proteins. Serial dilutions of purified proteins were added to HEK293 (TLR5+) cells overnight and IL-8 content of the supernatants measured by ELISA. Purified STF2.OVA was used as a positive control (FIG. 72A). The TLR2 agonist Pam3CSK4 was used as a negative control (FIG. 72B).
Figure 62B:
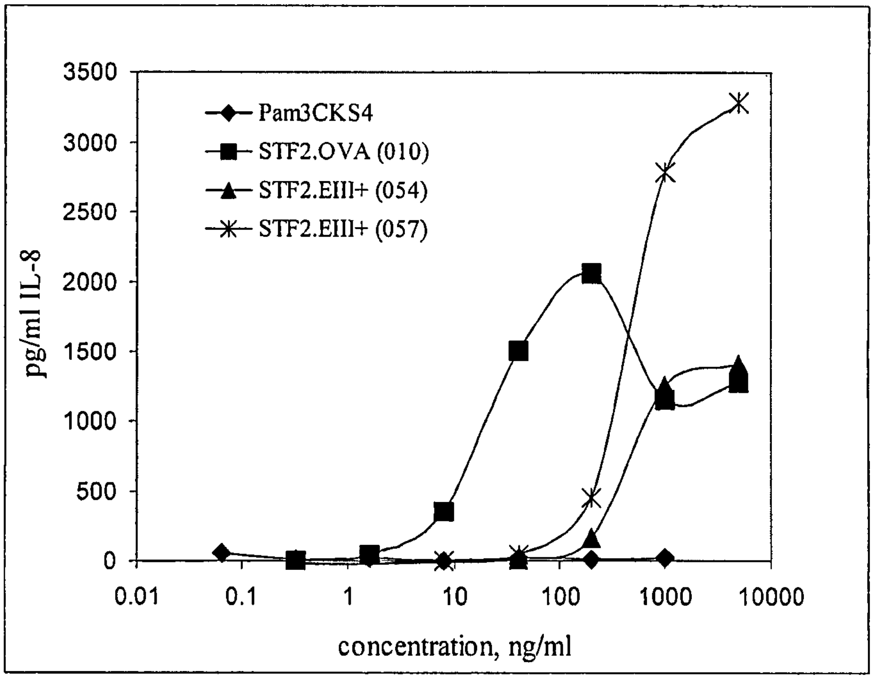

To compare the PAMP activity of both fusion proteins, a TLR5 bioassay was performed. HEK293 IL-8 cells were treated with serial dilutions of two independent protein batches (FIGS. 62A and 62B). Cultures were incubated for a 24 hour period and conditioned media were harvested and assayed for IL-8 production by ELISA. As shown in FIG. 62A, STF2Δ.EIII+ showed potent TLR-5 activity. Regression analysis of the titration curve determined the $EC_{50}$ of batches 2004-044 and 2004-045 to be 1.13 ng/ml and 4.34 ng/ml, respectively (Table 11, supra). In both cases, the TLR5 specific-activity was at least about 10-fold higher than the control protein STF2.OVA. In contrast, 2 preparations of STF2.EIII+ showed significantly weaker TLR5 activity than STF2.OVA. The $EC_{50}$ of STF2.EIII+ batches 054 and 057 were about 1195.00 ng/ml and about 197.92 ng/ml.

Antigenicity of STF2.EIII+ and STF2Δ.EIII+

Figure 63:
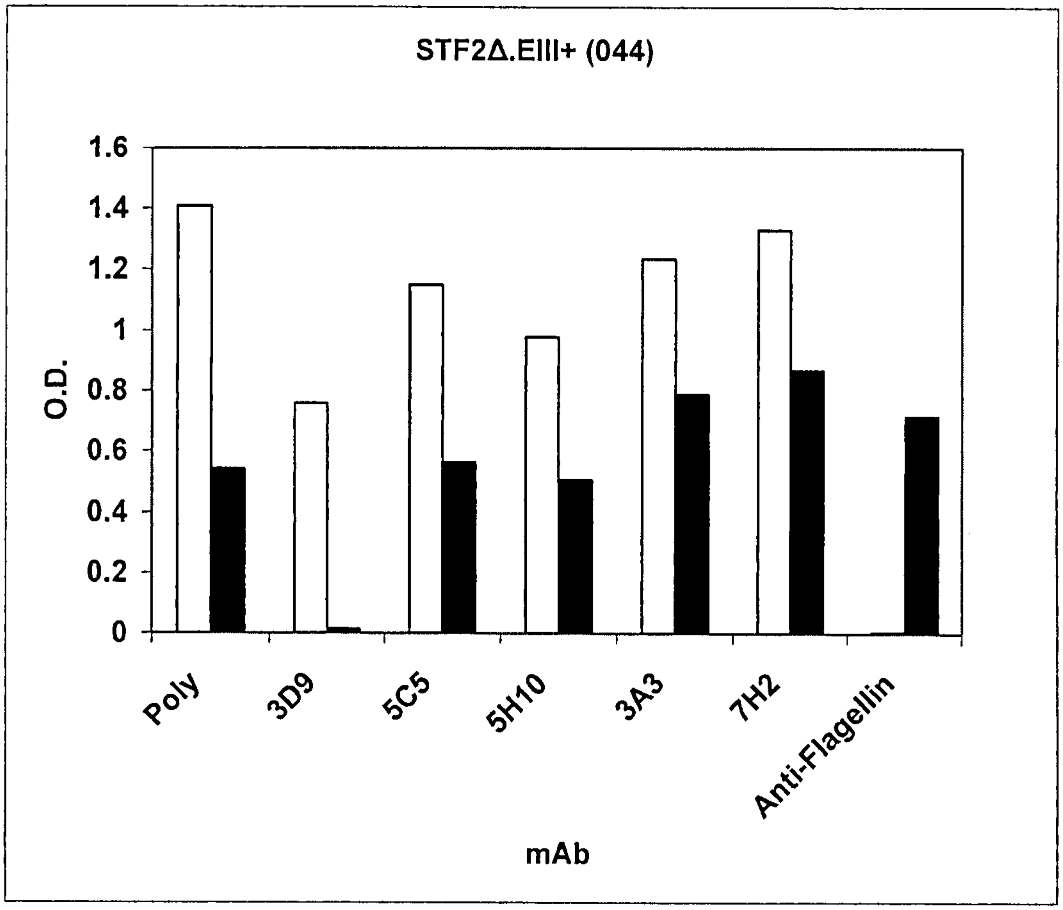
FIG. 63 depicts STF2Δ.EIII+ antigenic epitopes assessed by ELISA. Plates were coated with full-length WNE (open bars) (SEQ ID NO: 642) or STF2Δ.EIII+ (SEQ ID NOS: 673, 674) and probed with the indicated antibodies (mAb). Poly=polyclonal antiserum to WNE; 3D9 through 7H2=neutralizing monoclonal antibodies to WNE epitopes; anti-flagellin=monoclonal antibody to flagellin.
Figure 64A:
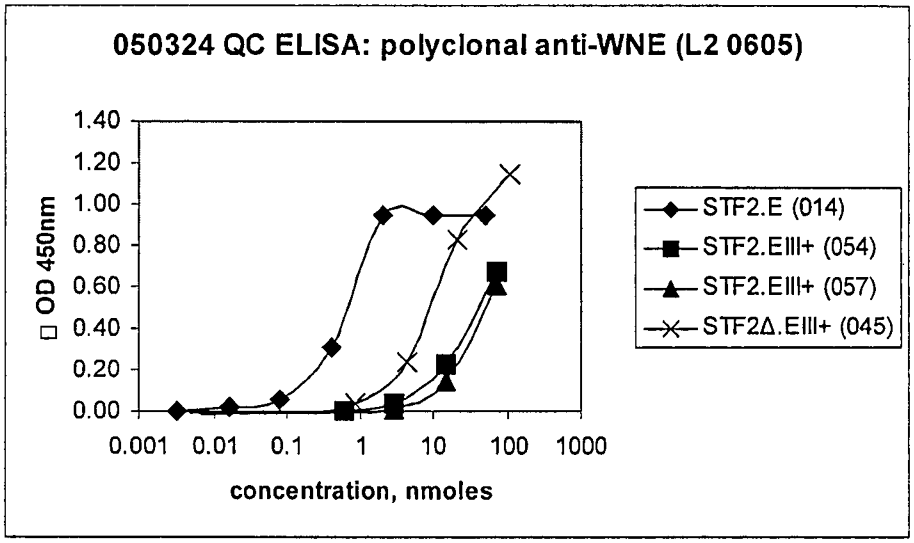
FIGS. 64A, 64B, 64C and 64D depict reactivity of STF2.E (SEQ ID NOS: 761, 762); STF2.EIII+ (SEQ ID NOS:657, 658) and STF2Δ.EIII+ (SEQ ID NOS:673, 674) fusion proteins with antibodies to WNE and flagellin. Plates were coated with fusion proteins, blocked and incubated with antibodies to WNE or flagellin. Antibody reactivity was detected following incubation with HRP-labeled species specific IgG. Plates were developed in the presence of TMB substrate and O.D.450/650 using a TECAN plate reader and Magellian software.
Figure 64B:
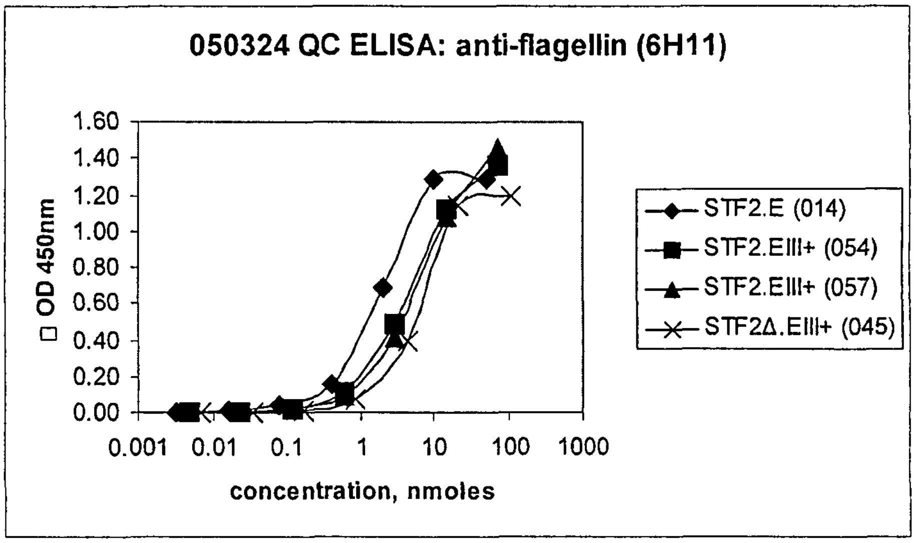
Figure 64C:
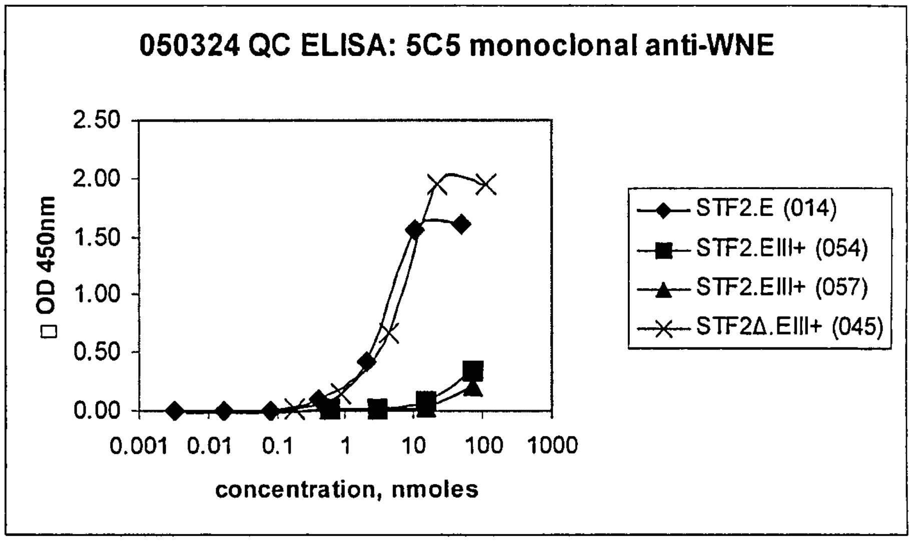
Figure 64D:
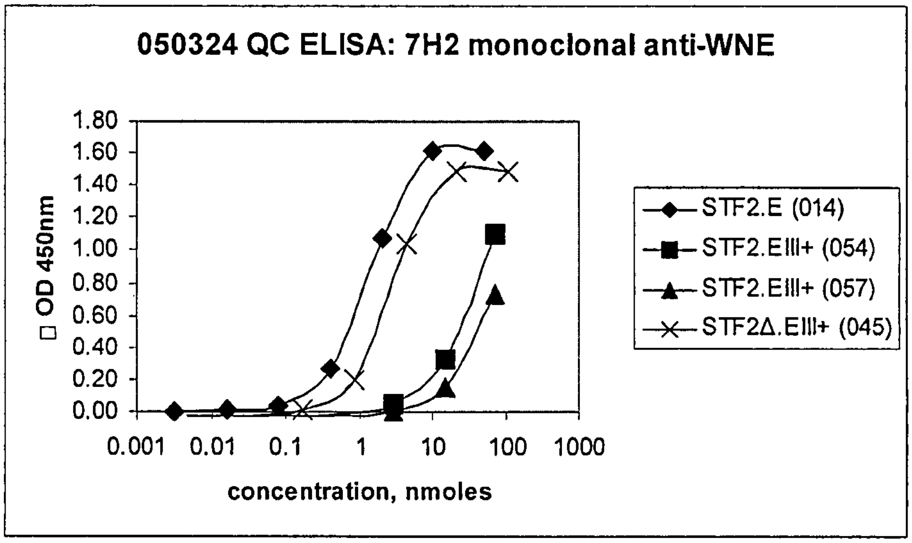

The antigenicity of STF2.EIII+ and STF2Δ.EIII+ was examined by direct ELISA using a flagellin monoclonal antibody specific for the N-terminal region of STF2 (6H11, Inotek Pharmaceuticals, Beverly, Mass.) and a panel of WNV-E-specific antibodies (5C5, 5H10, 3A3, 7H2 and 3D9, Bioreliance, Road Rockville, Md.) previously shown to neutralize West Nile virus in vitro. As shown in FIG. 63, a comparison of the reactivity of full length West Nile virus envelope protein with STF2Δ.EIII+ revealed that West Nile virus monoclonal antibodies 5C5, 5H10, 3A3 and 7H2, but not 3D9 recognize the fusion protein. This pattern of reactivity is consistent with the proposed location of 5C5, 5H10, 3A3 and 7H2 epitopes within EIII. The epitope for 3D9 lies outside of domain III of the West Nile virus envelope protein. As expected, all West Nile virus monoclonal antibodies reacted with full length West Nile virus envelope protein and the flagellin monoclonal only reacted with STF2Δ.EIII+. Both proteins reacted with a polyclonal West Nile virus envelope antiserum, but STF2Δ.EIII+ reactivity was somewhat reduced, perhaps due to the reduced number of potential epitopes present in the smaller domain.

Using 5C5 and 7H10 WNV monoclonal antibodies, a direct antigenic comparison was made between STF2.EIII+ and STF2Δ.EIII+ (FIGS. 64A, 64B, 64C and 64D). In these studies, plates were coated with the indicated proteins and then detected with polyclonal rabbit anti-E, or mouse monoclonal antibodies as described. As shown in FIGS. 64A, 64B, 64C and 64D, both STF2.EIII+ and STF2Δ.EIII+ were readily detected with the flagellin monoclonal antibody with no significant differences in reactivity. However, distinct reactivity with the anti-envelope monoclonal antibodies was observed. The reactivity of STF2Δ.EIII+ with either 5C5 or 7H2 was significantly greater than that observed with STF2.EIII+. Collectively, these results indicate that the flagellin 6H11 epitope of STF2Δ.EIII+ is uncompromised and is comparable to the flagellin sequence of STF2.EIII+. They also highlight distinct differences in the antigenicity of the EIII domains of these proteins and indicate that STF2Δ.EIII+ contains more of the critical conformation dependent neutralizing epitopes than STF2.EIII+.

Efficacy and Immunogenicity

Several efficacy studies designed to examine the protective efficacy our candidates in C3H/HeN mice following challenge with West Nile virus have been completed. Studies typically consisted of 5 groups of mice (10 mice per group) immunized intraperitoneally (i.p.) or subcutaneously (s.c.) on days 0, 14 and 28. On days 21 and 35, sera were harvested and tested for West Nile virus envelope protein-IgG antibody (ELISA) and the ability to neutralize West Nile virus in vitro (PRNT assay). On day 35, mice were challenged with a lethal dose of West Nile virus strain 2741. Survival was monitored for 21 days post-challenge.

Figure 65:
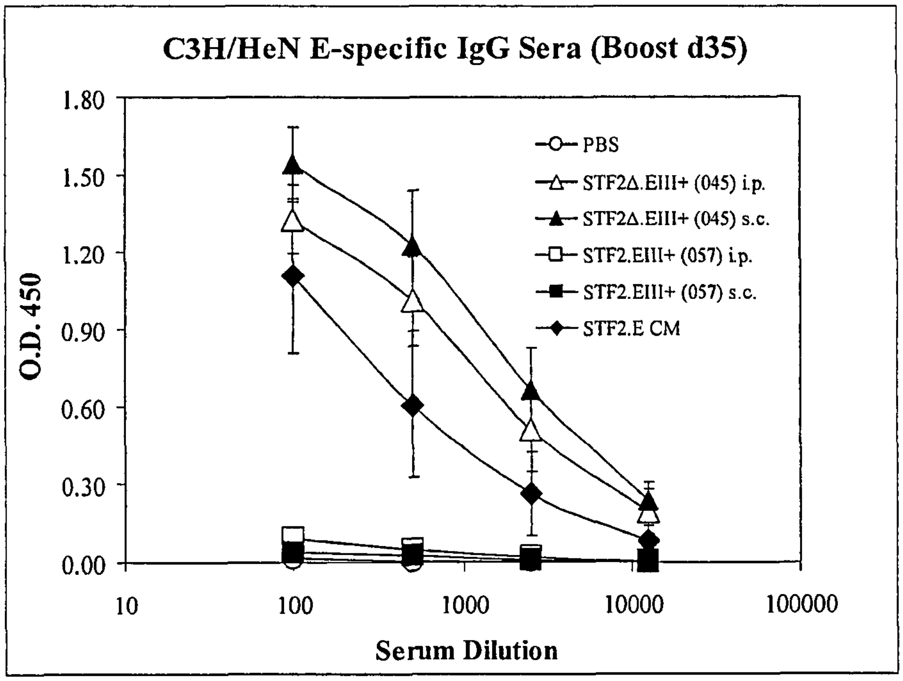
FIG. 65 depicts IgG serum following injection with fusion proteins. Mice were immunized with either PBS, *Drosophila* conditioned medium containing STF2.E (CM, positive control), 25 μg of STF2Δ.EIII+ (SEQ ID NOS:673, 674) i.p., 25 μg STF2Δ.EIII+ s.c., 25 μg STF2.EIII+ (SEQ ID NO:659, 658) i.p, 25 μg STF2.EIII+ (SEQ ID NOS:657, 658) or 25 μg STF2.E (SEQ ID NOS: 761, 762). On day 35, immunized animals were challenged with WNV. Sera from individual mice (day 35) were characterized by direct ELISA to determine IgG levels. Purified WNV-E protein (SEQ ID NO:642) was used as the antigen in this assay. This antigen (60) was produced in *Drosophila* as a his-tagged protein.
Figure 66:
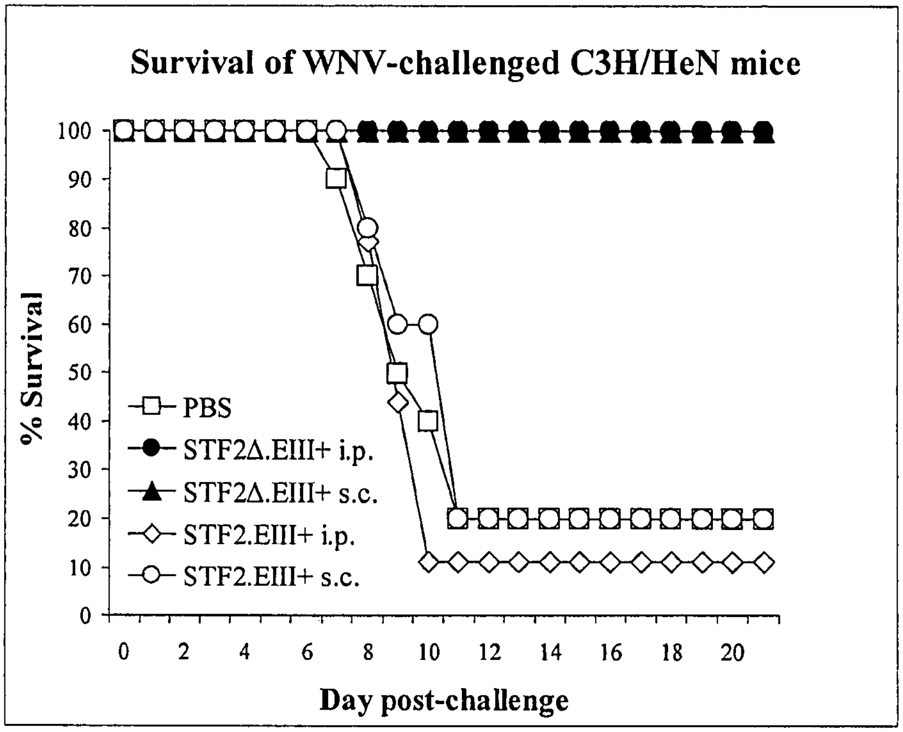
FIG. 66 depicts STF2Δ.EIII+ (SEQ ID NOS: 673 674) and STF2.EIII+ (SEQ ID NOS: 657, 658) protective immunity to WNV viral challenge. Mice were immunized and challenged with a lethal dose of WNV strain 2741 on day 35. Survival was monitored for 21 days.

Mice were immunized with PBS, *Drosophila* conditioned medium containing STF2.E (CM, positive control), 25 μg of STF2Δ.EIII+ i.p., 25 μg STF2Δ.EIII+ s.c., 25 μg STF2.EIII+ i.p. and 25 μg STF2.EIII+ s.c. The West Nile virus envelope protein antibody responses and survival data are shown FIGS. 65 and 66. By day 35 all groups that received STF2Δ.EIII+ had significant levels of West Nile virus envelope protein IgG. In contrast, mice that received STF2.EIII+ had no measurable West Nile virus envelope protein antibody response. Administration of STF2Δ.EIII+ i.p. or s.c led to 100% survival following West Nile virus challenge. Consistent with the poor immunogenicity of STF2.EIII+, little to no protection was provided by this candidate when compared to the PBS control. The poor immunogenicity and efficacy of STF2.EIII+ in this study are attributed to the reduced TLR5 activity and/or the weak EIII epitope reactivity of this protein.

Plaque Reduction Neutralization Titers

To further evaluate the West Nile virus envelope protein antibody response elicited by STF2Δ.EIII+ and potentially correlate protective efficacy with neutralizing antibody titers, the plaque reduction neutralization test (PRNT) was performed. Day 35 serum samples from efficacy studies described above were tested for their ability to block West Nile virus infection in cultured Vero cells. Briefly, pooled mouse serum samples were heat-inactivated and serially diluted two-fold in PBS with 0.5% gelatin. Dilutions starting with 1:10 were incubated with about 100 pfu of the West Nile virus strain 2741. The virus/serum mixture was incubated at about 37° C. for 1 h and then inoculated onto confluent monolayers of Vero cells (ATCC, Catalog Number CCL-81, Manassas, Va.) in duplicate wells of 6-well tissue culture plates. The virus was allowed to adsorb to the cell monolayer prior to adding a 1% agarose overlay. Infected cell cultures were incubated for 4 days at 37° C. followed by a second agarose overlay containing 4% neutral red. Virus plaques were counted 12 h later. Serum titers that led to 80% reduction in viral plaque numbers ($PRNT_{80}$) were recorded.

A summary of the $PRNT_{80}$ data from efficacy studies concerning STF2.EIII+ and STF2Δ.EIII+ is presented in Table 12 below. In two independent studies involving STF2.EIII+ where survival of about 50% or less was reported, pooled sera failed to inhibit plaque formation. This finding is not surprising given the weak antibody response elicited by this construct. In three efficacy studies involving STF2Δ.EIII+ where survival was about 70% or greater, pooled sera had neutralization titers of 1:40 or better. Neutralization titers of 1:40 or greater typically correlate with protection in vivo.

TABLE 12

Survivial and $PRNT_{80}$ Results for STF2.EIII+ (SEQ ID NO: 658), STF2Δ.EIII+ (SEQ ID NO: 674) and STF2.E (SEQ ID NO: 762) CM (Control Media) Fusion Proteins

| Batch | Candidate | Route | Study # | Survival (%) | $PRNT_{80}$ (dilution) |
|---|---|---|---|---|---|
| 054 | STF2.EIII+ | i.p. | 3 | 50 | Negative |
| 057 | STF2.EIII+ | i.p. | 4 | 11 | Negative |
| 057 | STF2.EIII+ | s.c. | 4 | 20 | negative |
| 044 | STF2Δ.EIII+ | i.p. | 2 | 70 | 1:40 |
| 045 | STF2Δ.EIII+ | i.p. | 3 | 90 | 1:40 |
| 045 | STF2Δ.EIII+ | s.c. | 3 | 100 | 1:160 |
| 045 | STF2Δ.EIII+ | i.p. | 4 | 100 | 1:80 |
| 045 | STF2Δ.EIII+ | s.c. | 4 | 100 | 1:40 |
| — | STF2.E CM | i.p. | 3 | 90 | 1:640 |
| — | STF2.E CM | i.p. | 4 | — | 1:1280 |

STF2ΔEIIIs+ a Modified Version of STF2Δ.EIII+

Protein preparations of STF2Δ.EIII+ tested in the mouse efficacy studies described above were purified by anion-exchange and size-exclusion chromatography steps carried out under denaturing conditions followed by refolding using step-wise dialysis. With this process, two predominant species that correspond to the monomeric and trimeric forms of STF2Δ.EIII+ were generated and present as a mixture in the final product. To minimize the heterogeneity of the final product, new refolding and purification methods have been developed that favor the production of either monomer or trimer. Because it is unclear which form of STF2Δ.EIII+ is the active component or if both are equally potent, both species have been produced in milligram quantities and tested for efficacy in mice.

It was initially unclear as to why STF2Δ.EIII+ refolding resulted in the formation of a trimeric species. However, when the sequence of the STF2Δ.EIII+ expression construct was re-examined, we identified a cysteine residue within the linker sequence that separates STF2Δ from EIII+. The presence of this cysteine would likely interfere with the formation of the appropriate disulfide bond during refolding and might account for the trimeric form of STF2Δ.EIII+. This unnecessary cysteine was changed to a serine using site-directed mutagenesis and the modified protein (STF2Δ.EIII+) was produced and purified. It should be noted that refolding the serine-substituted construct yielded only monomeric protein.

Figure 67:
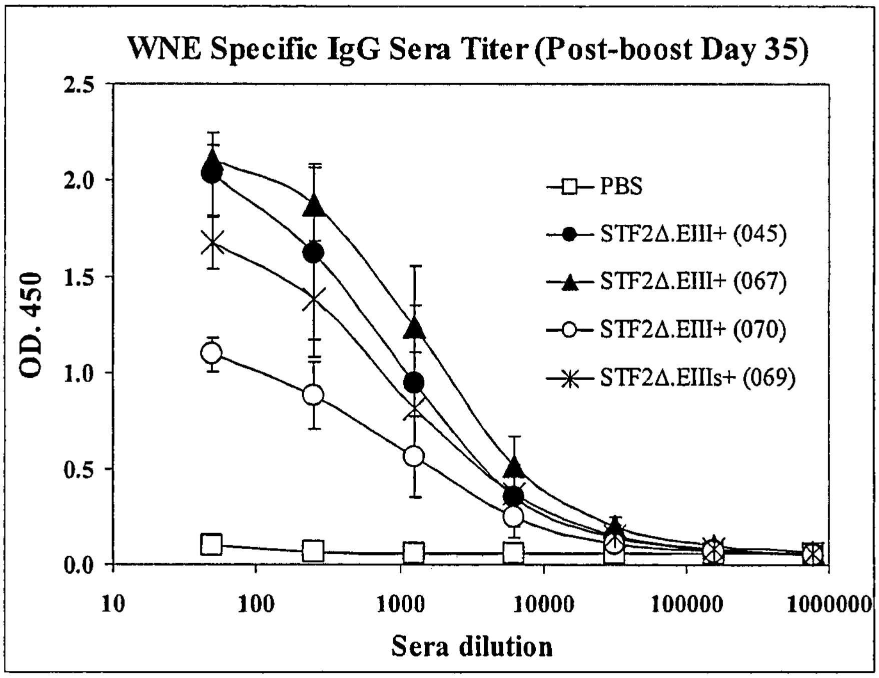
FIG. 67 depicts IgG sera titers following immunization with fusion proteins. STF2Δ.EIII+ proteins induce WNV-specific IgG antibodies. Mice were immunized s.c. on days 0, 14 and 28 with PBS alone or about 25 μg of STF2Δ.EIII+ (SEQ ID NOS: 673, 674) (045 [positive control]). STF2Δ.EIII+ (067, trimer), STF2Δ.EIII+ (070, monomer) or STF2Δ.EIIIs+ (SEQ ID NOS: 675, 676) (069). On day 35 sera from individual mice were characterized by direct ELISA to determine IgG levels. Purified WNV-E protein (060, produced in *Drosophila* as a his-tagged protein) was used as the antigen in this assay.
Figure 68:
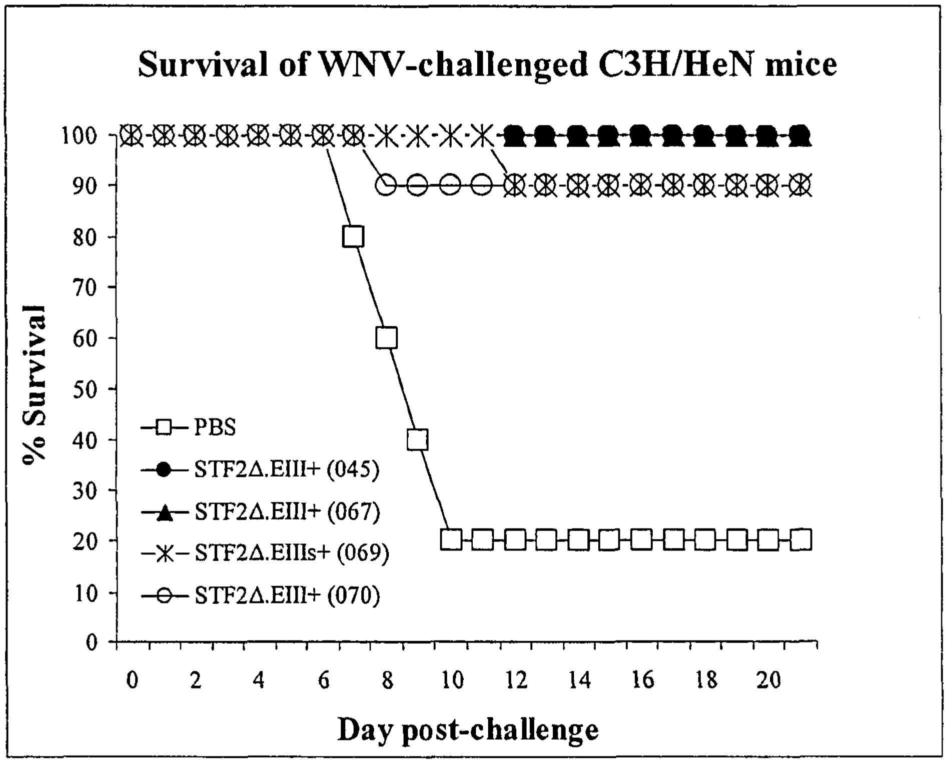
FIG. 68 depicts STF2Δ.EIII+ (SEQ ID NOS: 673, 674) and STF2Δ.EIIIs+ (SEQ ID NOS: 675, 673) protective immunity in mice from WNV lethal challenge. On day 38 following immunization with fusion proteins, all groups were challenged with a lethal dose of WNV strain 2741 and survival was monitored for 21 days. Survival for each group (10 mice/group) is indicated as a percentage.

Protective efficacy of STF2Δ.EIII+ (monomer) and STF2Δ.EIIIs+ (trimer) were evaluated in C3H/HeN mice following challenge with West Nile virus. Five groups of mice (10 per group) were immunized with about 25 ug of protein s.c. on days 0, 14 and 28. On days 21 and 35, sera were harvested and tested for WNV-E IgG antibody (ELISA). On day 38, mice were challenged with a lethal dose of WNV strain 2741 and survival was monitored for 21 days. ELISA results from boost 2 (day 35, FIG. 67) and survival data (FIG. 68) indicate that all constructs elicited significant levels of WNV-E reactive IgG prior to viral challenge and provided about 90% to about 100% protection against the lethal infection. These findings indicate that monomeric or multimeric (e.g., trimers) forms of STFΔ.EIII+ are efficacious and removal of the additional cysteine from the construct does not appreciably impact potency. Removal of the cysteine within the linker sequence may simplify purification of the protein by reducing heterogeneity following protein refolding.

Conclusion

Two recombinant fusion proteins containing the *Salmonella typhimurium* flagellin (STF2) fused to EIII+ domain of West Nile virus envelope protein have been generated. One includes the full length STF2 sequence (STF2.EIII+) and the other a modified version of STF2 that lacks the internal hypervariable region of STF2 (STF2Δ.EIII+). Both proteins have been expressed in *E. coli* and purified by conventional means using anion exchange chromatography and gel filtration. STF2.EIII+ was produced as a soluble protein and was purified under non-denaturing conditions. In contrast, STF2Δ.EIII+ was expressed as an insoluble protein and was purified under denaturing conditions and refolded by stepwise dialysis to remove urea. In HEK293 IL8 assays, preparations of STF2Δ.EIII+ showed greater TLR-5 activity than STF2.EIII+.

In envelope protein epitope display analysis using ELISA assays and West Nile virus envelope protein antibodies, STF2Δ.EIII+ displayed more of the critical conformation dependent neutralizing epitopes. Consistent with the potent TLR-5 activity and envelope protein epitope antigenicity observed with STF2Δ.EIII+, STF2Δ.EIII+ was highly immunogenic and efficacious in mice challenged with a lethal dose of West Nile virus. Because monomeric and trimeric species of STF2Δ.EIII+ were generated during the purification process of this protein, a cysteine within the linker sequence of the expression construct was changed to a serine. Removal of this cysteine eliminated the production of trimeric forms of the protein during refolding and resulted in the generation of monomeric product that displayed potent efficacy in vivo.

Japanese Encephalitis Fusion Protein

JE virus is localized in Asia and northern Australia (about 50,000 cases with about 10,000 deaths annually). An approved inactivated virus vaccine was recently associated with a case of acute disseminated encephalomyelitis, prompting the Japanese Ministry of Health, Labor and Welfare to recommend the nationwide suspension of the vaccine. Given the complexities of producing inactivated viruses in infected mouse brains or even in cell culture, and the potential for adverse events associated with inactivated viruses, the opportunity for recombinant-based JE vaccine is appealing.

A STF2Δ.JEIII+ fusion construct was constructed. The JE EIII+ DNA fragment was generated synthetically and codon optimized for expression in *E. coli*. The sequence was ligated into pET24STF2Δ to generate pETSTF2Δ.JEIII+. Expression constructs have been screened by restriction analysis and for expression in *E. coli* BLR(DE3) by IPTG induction. The DNA sequence of each construct has been confirmed, and production of the protein has been scaled up. A batch of material has been generated. A total of about 24 mg of material was purified. This material has potent TLR5 activity, acceptable levels of endotoxin (about 0.03 EU/μg) and a A280/A260 ratio of about 1.3.

Flavivirus Peptides

Identification of WNV-E Specific Antibody Epitopes

Figure 69:
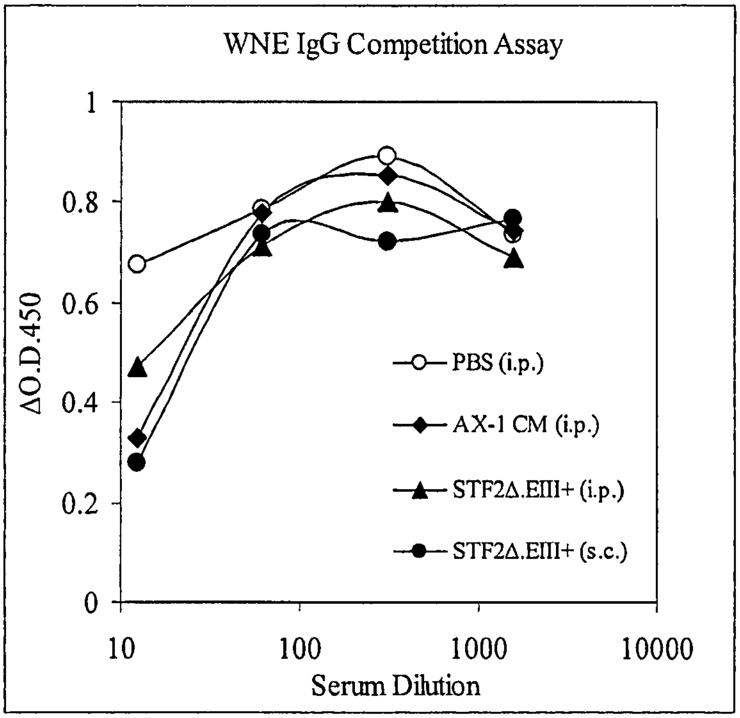
FIG. 69 depicts competition assays. Serial dilutions (five fold starting at 1:25) of antisera from immunized animals were incubated with biotinylated WNE protein (SEQ ID NO: 642) and then added to the wells of ELISA plates coated with mAb 7H2 at about 2 mg/ml. Wells were developed using avidin-HRP to determine inhibition of West Nile protein binding as a results of competition with mAb 7H2.
Figure 70:
FIG. 70 depicts epitope mapping of the antibody response induced by STF2Δ.EIII+ (SEQ ID NOS: 675, 676) fusion proteins. Immune sera from animals immunized with indicated STF2Δ-fusion proteins (E2-21, E27-E52) were examined for the ability to recognize overlapping peptides corresponding to the junction of domains I and III of the WNV envelope protein.
Figure 71:
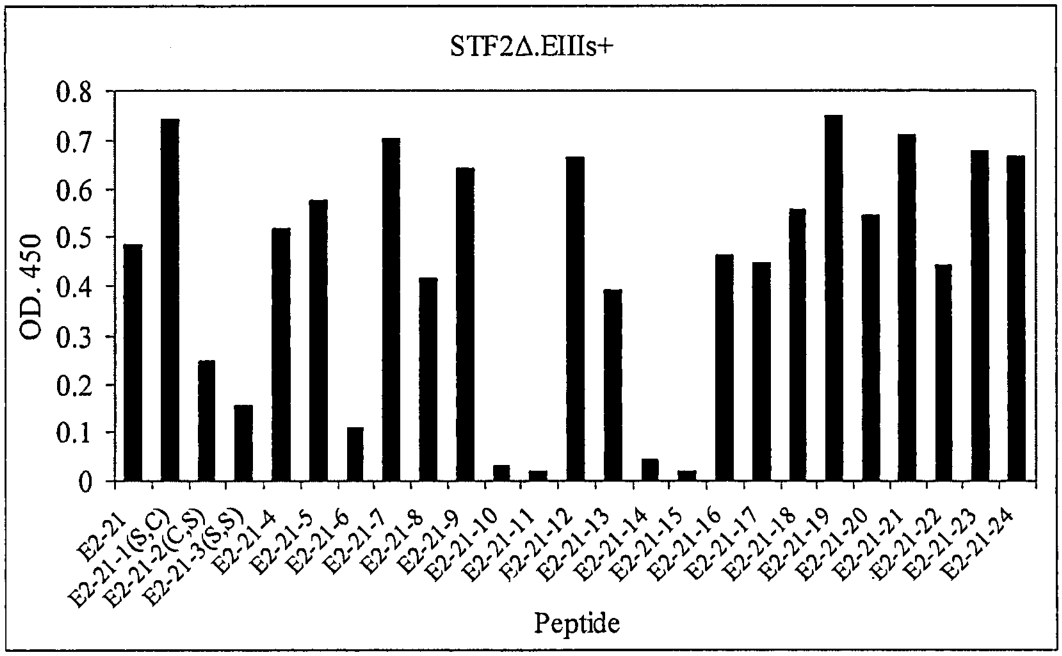
FIG. 71 depicts epitope mapping of the antibody response induced by STFΔ.EIIIs+ (SEQ ID NOS: 675, 676) E-21 (envelope protein) epitope fusion proteins. Immune sera from animals immunized with the indicated STF2Δ-fusion proteins (E2-21, E2-21-1(S,C), E2-21-2(C,S), E2-21-2(C,S) and E2-21-4 through E2-21-24) were evaluated to identify the residues defining the E-21 epitope of West Nile envelope protein. Data reflects the response of sera to E-21 following the substitution of cysteine with serine (indicated by C,S); and the sequential replacement of amino acids with alanine.

To identify linear epitopes within the West Nile virus envelope protein that are recognized by antisera from STF-Δ.EIIIs+ immunized mice, several synthetic peptide arrays were generated. One array consisted of overlapping peptides of 20 amino acids in length that spanned the entire West Nile virus domain III and parts of domain II (SEQ ID NOS: 728-754). ELISA results with this array identified a highly reactive 20 amino acid sequence that mapped to the N-terminal region of domain III and included part of the domain I domain CRVKMEKLQLKGTTYGVCSK (SEQ ID NO: 728). To fine map this epitope, additional arrays were generated that focused on the domain I and II junctions (SEQ ID NOS: 703-754). These arrays included an alanine substitution scan to identify amino acids critical for antibody binding (SEQ ID NOS: 728-754). As shown in FIGS. 69 and 70, antisera from STF2Δ.EIII (monomer and trimer) and STF2Δ.EIIIs+ immunized mice reacted with peptides that spanned the EI/EIII junction (peptides E-30 to E-42) and included the E2-21 peptide CRVKMEKLQLKGTTYGVCSK (SEQ ID NO: 728). This reactivity was severely reduced when specific amino acids (E6, K7, L10 and K11) were changed to alanines (FIG. 71). Although it is not known if the antibodies that recognize this epitope are neutralizing, efforts are underway to design and test a peptide vaccine based on this region of WNV-E.

Immunogenicity of Pam3Cys.WNV001 Peptide Vaccine

Figure 72:
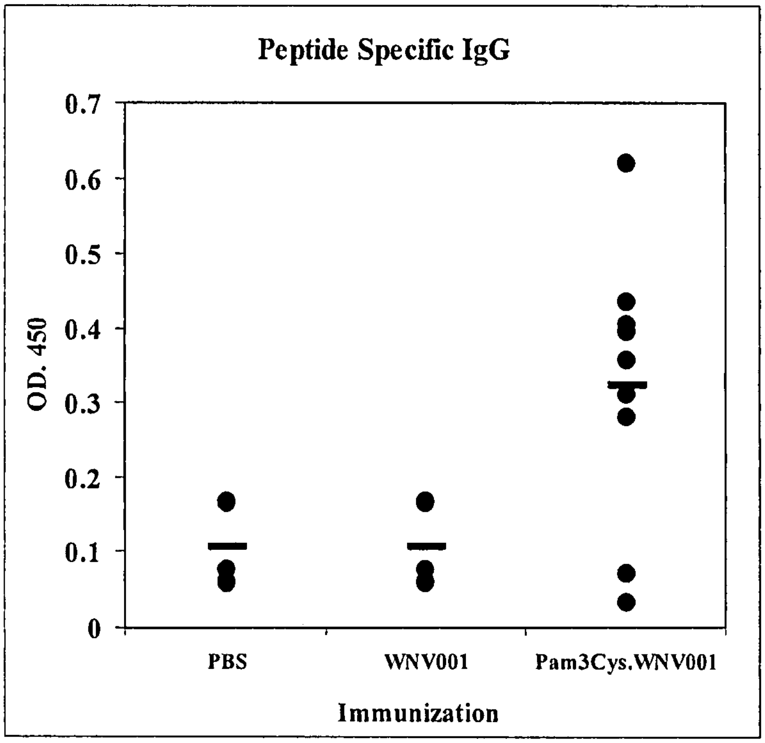
FIG. 72 depicts Pam3Cys.WNV001 (SEQ ID NO: 771) inducing EIII specific IgG antibodies. Mice were immunized s.c. on days 0, 14 and 28 with PBS alone, 22 mg of unmodified WNV001 (SEQ ID NO: 771) or 30 μg of Pam3Cys.WNV001. On day 35 sera from individual mice were characterized by direct ELISA to determine IgG levels to synthetic WNV001 peptide.

A lipidated West Nile virus envelope protein fused to Pam3Cys on the N-terminal end was synthesized using the 20 amino acid sequence LTSGHLKCRVKMEKLQLKGT (SEQ ID NO:772) (Putnak, R., et al, *Vaccine* 23:4442-4452 (2005)). The immunogenicity of this peptide was tested in C3H/HeN mice and compared to peptide without Pam3Cys (FIG. 72). The reactivity of antisera from immunized animals was tested by direct ELISA as described in the legend and the results indicate that the Pam3Cys.WNV001 peptide is significantly more immunogenic than the peptide without the TLR2 modification. The antisera from these studies will be tested in virus neutralization assays (PRNT) to determine if the antibodies elicited will neutralize West Nile virus in vitro. The lipidated peptide will also be tested in the West Nile virus challenge model to assess protective efficacy against a lethal virus challenge.

Assay Development

Competition ELISA Assay Development

To assess the neutralizing potential of antisera derived from immunized mice, a competition ELISA assay was developed using well-characterized monoclonal antibody (7H2) that neutralizes West Nile virus in culture and reacts with a conformation-sensitive epitope within the EIII domain of the West Nile virus envelope protein antigen. The assay was designed as a capture ELISA that measures the ability of sera from immunized animals to prevent 7H2 from binding West. Nile virus envelope protein. Serial dilutions ranging from 1:10 to 1:5000 of day 35 mouse antisera from efficacy study 4 (FIGS. 65 and 66, Table 13) were incubated with biotinylated West Nile virus envelope protein and then added to ELISA plates pre-coated with 7H2 monoclonal antibody (Bioreliance, Road Rockville, Md.). Following several washes to remove unbound material, bound West Nile virus envelope protein was detected using avidin-HRP. Results from a representative experiment are shown in FIG. 69. At dilutions of 1:25, a measurable loss of West Nile virus envelope protein binding to 7H2-coated plates was observed when antisera derived from animals immunized with STF2Δ.EIIIs where tested. No competition was detected with antisera derived from mock immunized animals that received PBS in place of antigen. These initial results demonstrate that antibodies elicited by STF2Δ.EIII+ compete with 7H2 for binding West Nile virus envelope protein. These findings are consistent with the protection from WNV infection observed in animals immunized with STF2Δ.EIII+ and help establish a correlation between antibody epitope reactivity in vitro and efficacy in vivo.

While this invention has been particularly shown and described with references to example embodiments thereof, it will be understood by those skilled in the art that various changes in form and details may be made therein without departing from the scope of the invention encompassed by the appended claims.

SEQUENCE LISTING (842 sequences)

SEQ ID NO: 1 - protein, 565 aa, Influenza A/Puerto Rico/8/34 HA
MKANLLVLLSALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 2 - protein, 564 aa, Influenza A/Vietnam/1203/2004 HA
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTDYPQYSEEARLKREEISGVKLESIGIYQILSIYSTVASSLALAIMVAGLSLWMCSNGSLQCR

SEQ ID NO: 3 - protein, 568 aa, Influenza A/Indonesia/5/2005 HA
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 4 - protein, 565 aa, Influenza A/NewCaledonia/20/1999
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 5 - protein, 566 aa, Influenza A/South Carolina/1/18HA
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQILAIYSTVASSLVLLVSLGAISFWMCSNGSLQCRICI

SEQ ID NO: 6 - protein, 329 aa, Influenza A/Wisconsin/67/2005 HA
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTR

SEQ ID NO: 7 - protein, 328 aa, Influenza A/X31 subtype H3N2 HA
QDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVIQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQT

SEQ ID NO: 8 - protein, 272 aa, Artificial Sequence
  PR/8 HA1-1
SHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVR

SEQ ID NO: 9 - protein, 223 aa, Artificial Sequence
  PR/8 HA1-2
KGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 10 - protein, 176 aa, Artificial Sequence
  PR/8 HA1-3
NSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRG

SEQ ID NO: 11 - protein, 274 aa, Artificial Sequence
  VN HA1-1
EKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 12 - protein, 223 aa, Artificial Sequence
  VN HA1-2
GVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 13 - protein, 174 aa, Artificial Sequence
  VN HA1-3
NDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKG

SEQ ID NO: 14 - protein, 274 aa, Artificial Sequence
  IND HA1-1
EKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVK

SEQ ID NO: 15 - protein, 223 aa, Artificial Sequence
  IND HA1-2
GVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSE

SEQ ID NO: 16 - protein, 174 aa, Artificial Sequence
  IND HA1-3
NDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKG

SEQ ID NO: 17 - protein, 272 aa, Artificial Sequence
  NC HA1-1
SHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVR

SEQ ID NO: 18 - protein, 223 aa, Artificial Sequence
  NC HA1-2
KGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITS

SEQ ID NO: 19 - protein, 176 aa, Artificial Sequence
  NC HA1-3
NPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRG

SEQ ID NO: 20 - protein, 267 aa, Artificial Sequence
  WIS HA1-1
QSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVK

SEQ ID NO: 21 - protein, 218 aa, Artificial Sequence
  WIS HA1-2
SPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSD

SEQ ID NO: 22 - protein, 169 aa, Artificial Sequence
  WIS HA1-3
SNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSG

SEQ ID NO: 23 - protein, 511 aa, Influenza A/Puerto Rico/8/34 HA0s
DTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQ

SEQ ID NO: 24 - protein, 223 aa, Artificial Sequence
  PR/8 HA1-2mut
KGAAPLQLGKCNIAGWLLGNPECDPLLPVRSWSDIAETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 25 - protein, 176 aa, Artificial Sequence
  PR/8 HA1-3mut
NSENEICYPGDFIDKEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAAALSRG

SEQ ID NO: 26 - protein, 223 aa, Artificial Sequence
  VN HA1-2mut
GAKPLSLRDCSVAGWLLGNPMCDEFINVPEWSDIAEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 27 - protein, 174 aa, Artificial Sequence
  VN HA1-3mut
NDLCYPGDFNDKEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIAKKG

SEQ ID NO: 28 - protein, 223 aa, Artificial Sequence
  IND HA1-2mut
GAKPLSLRDCSVAGWLLGNPMCDEFINVPEWSDIAEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSE

SEQ ID NO: 29 - protein, 174 aa, Artificial Sequence
  IND HA1-3mut
NDLCYPGSFNDKEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIAKKG

SEQ ID NO: 30 - protein, 223 aa, Artificial Sequence
  NC HA1-2mut
KGAAPLQLGNCSVAGWILGNPECELLISKESWSDIAETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITS

SEQ ID NO: 31 - protein, 176 aa, Artificial Sequence
  NC HA1-3mut
NPENETCYPGYFADKEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAAALSRG

SEQ ID NO: 32 - protein, 218 aa, Artificial Sequence
  WIS HA1-2mut
SPHQALDGENCTLIDALLGDPQCDGFQNKKWDDFAERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSD

SEQ ID NO: 33 - protein, 169 aa, Artificial Sequence
  WIS HA1-3mut
SNCYPKDSPDEASLRSLVASSGTDEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSG

SEQ ID NO: 34 - protein, 320 aa, Influenza A/Swine/Hong Kong/9/98 HA
DKICIGYQSTNSTETVDTLTETNVPVTHAKELLHTEHNGMLCATNLGHPLILDTCTIEGLIYGNPSCDLLLGGREWSYIVERPSAVNGMCYPGNVENLEELRSLFSSASSYQRIQIFPDTIWNVSYSGTSKACSDSFYRSMRWLTQKNNAYPIQDAQYTNNRGKSILFMWGINHPPTDTVQTNLYTRTDTTTSVTTEDINRTFKPVIGPRPLVNGLHGRIDYYWSVLKPGQTLRVRSNGNLIAPWYGHILSGESHGRILKTDLNSGNCVVQCQTERGGLNTTLPFHNVSKYAFGNCPKYVGVKSLKLAVGLRNVPARSSR

SEQ ID NO: 35 - protein, 566 aa, Influenza A//Aichi/2/1968 HA
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 36 - protein, 584 aa, Influenza B/Lee/40 HA
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHTILLYYSTAASSLAVTLMIAIFIVYMVSRDNVSCSICL

SEQ ID NO: 37 - protein, 655 aa, Influenza C/Johannesburg/1/66
MFFSLLLVLGLTEAEKIKICLQKQVNSSFSLHNGFGGNLYATEEKRMFELVKPKAGASVLNQSTWIGFGDSRTDKSNSAFPRSADVSAKTADKFRSLSGGSLMLSMFGPPGKVDYLYQGCGKHKVFYEGVNWSPHAAINCYRKNWTDIKLNFQKNIYELASQSHCMSLVNALDKTIPLQVTAGTAGNCNNSFLKNPALYTQEVKPSENKCGKENLAFFTLPTQFGTYECKLHLVASCYFIYDSKEVYNKRGCDNYFQVIYDSSGKVVGGLDNRVSPYTGNSGDTPTMQCDMLQLKPGRYSVRSSPRFLLMPERSYCFDMKEKGPVTAVQSIWGKGRESDYAVDQACLSTPGCMLIQKQKPYIGEADDHHGDQEMRELLSGLDYEARCISQSGWVNETSPFTEKYLLPPKFGRCPLAAKEESIPKIPDGLLIPTSGTDTTVTKPKSRIFGIDDLIIGLLFVAIVEAGIGGYLLGSRKESGGGVTKESAEKGFEKIGNDIQILKSSINIAIEKLNDRISHDEQAIRDLTLEIENARSEALLGELGIIRALLVGNISIGLQESLWELASEITNRAGDLAVEVSPGCWIIDNNICDQSCQNFIFKFNETAPVPTIPPLDTKIDLQSDPFYWGSSLGLAITATISLAALVISGIAICRTK

SEQ ID NO: 38 - protein, 293 aa, Artificial Sequence
  B/Lee/40 HA1-1
TTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVK

SEQ ID NO: 39 - protein, 240 aa, Artificial Sequence
  B/Lee/40 HA1-2
KGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKG

SEQ ID NO: 40 - protein, 267 aa, Artificial Sequence
  A/Aichi/2/68 HA1-1
QSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVK

SEQ ID NO: 41 - protein, 216 aa, Artificial Sequence
  A/Aichi/2/68 HA1-2
HRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSD

SEQ ID NO: 42 - protein, 358 aa, Influenza B/Malaysia/2506/2004 HA
IVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKER

SEQ ID NO: 43 - protein, 349 aa, Influenza B/Ohio/1/2005 HA
DRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGF

SEQ ID NO: 44 - protein, 338 aa, Influenza B/Shanghai/361/2002 HA
DRICTGITSSNSPHVVKTATQGEVNVTGVIPLTTTPIKSHFANLKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGHCPIWVKTPLKLANGTKYRP

SEQ ID NO: 45 - protein, 294 aa, Artificial Sequence
  B/Malaysia/2506/2004 HA1-1
TTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 46 - protein, 241 aa, Artificial Sequence
  B/Malaysia/2506/2004 HA1-2
KGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 47 - protein, 294 aa, Artificial Sequence
  B/Ohio/1/2005 HA1-1
TTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 48 - protein, 241 aa, Artificial Sequence
  B/Ohio/1/2005 HA1-2
KGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 49 - protein, 293 aa, Artificial Sequence
  B/Shanghai/361/2002 HA1-1
TTTPIKSHFANLKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGHCPIWVK

SEQ ID NO: 50 - protein, 240 aa, Artificial Sequence
  B/Shanghai/361/2002 HA1-2
KGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKG

SEQ ID NO: 51 - DNA, 1518 bp, Artificial Sequence
  Stf2.b1p
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttacgt

SEQ ID NO: 52 - DNA, 1539 bp, Artificial Sequence
  STF2.SG
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtagcggcagtggtagcggatcc

SEQ ID NO: 53 - DNA, 2361 bp, Artificial Sequence
  SFT2.HA1-1 PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtagcggcagtggtagcggatcctctcataacggtaaactgtgtcgtctgaaaggtattgcaccactgcagctgggcaaatgcaacatcgcgggttggctgctgggtaaccctgaatgtgacccgctgctgccggttcgttcctggagctacattgttgaaaccccgaactccgaaaacggtatctgctacccgggcgactttattgactatgaagaactgcgtgagcagctgtcttccgtgagcagctttgaacgcttcgaaatcttcccgaaggaaagctcctggccgaaccacaacactaacggcgtgacggcggcttgctcccacgaaggcaaatcttccttttatcgtaacctgctgtggctgactgaaaaggaaggttcctacccaaaactgaaaaacagctatgttaacaaaaagggtaaagaagtcctggtgctgtggggcatccaccacccgccgaactccaaggaacagcagaatctgtatcagaacgaaaacgcatacgtttctgtcgttacttccaactataaccgtcgtttcactccggaaatcgcggaacgtccgaaagtacgcgaccaggctggccgtatgaactactactggaccctgctgaaaccgggtgacactattatcttcgaagctaacggtaacctgatcgcaccaatgtacgctttcgcactgtctcgtggtttcggttccggcattatcaccagcaacgcgtctatgcacgaatgcaacacgaaatgtcagacgccgctgggcgcaattaatagcagcctgccgtaccagaacatccacccggtgactatcggcgaatgcccgaagtatgttcgttaatag

SEQ ID NO: 54 - DNA, 2379 bp, Artificial Sequence
  STF2.HA1-1.his PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcaaaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtagcggcagtggtagcggatcctctcataacggtaaactgtgtcgtctgaaaggtattgcaccactgcagctgggcaaatgcaacatcgcgggttggctgctgggtaaccctgaatgtgacccgctgctgccggttcgttcctggagctacattgttgaaaccccgaactccgaaaacggtatctgctacccgggcgactttattgactatgaagaactgcgtgagcagctgtcttccgtgagcagctttgaacgcttcgaaatcttcccgaaggaaagctcctggccgaaccacaacactaacggcgtgacggcggcttgctcccacgaaggcaaatcttccttttatcgtaacctgctgtggctgactgaaaaggaaggttcctacccaaaactgaaaaacagctatgttaacaaaaagggtaaagaagtcctggtgctgtggggcatccaccacccgccgaactccaaggaacagcagaatctgtatcagaacgaaaacgcatacgtttctgtcgttacttccaactataaccgtcgtttcactccggaaatcgcggaacgtccgaaagtacgcgaccaggctggccgtatgaactactactggaccctgctgaaaccgggtgacactattatcttcgaagctaacggtaacctgatcgcaccaatgtacgctttcgcactgtctcgtggtttcggttccggcattatcaccagcaacgcgtctatgcacgaatgcaacacgaaatgtcagacgccgctgggcgcaattaatagcagcctgccgtaccagaacatccacccggtgactatcggcgaatgcccgaagtatgttcgtcatcaccatcatcaccattaatag

SEQ ID NO: 55 - DNA, 2214 bp, Artificial Sequence
  STF2.HA1-2 PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgttctggttctggttctggttctaaaggtattgctccactgcaactgggtaaatgcaatattgcgggttggctgctgggcaacccggaatgcgatccgctgctgccggtccgttcctggagctatattgttgaaactccgaactctgagaacggcatctgctatccaggtgatttcattgactatgaggaactgcgtgaacaactgtcttccgtgtcttcctttgaacgtttcgagatttttcctaaagaatcttcttggccgaaccataacactaatggtgttaccgctgcgtgctctcatgaaggtaaatctagcttttaccgcaacctgctgtggctgaccgagaaagaaggttcttacccgaaactgaaaaacagctacgtaaacaaaaagggcaaggaagttctggtcctgtggggtatccaccatccgccgaacagcaaggaacagcagaatctgtatcagaacgaaaacgcatacgtatctgttgttacttctaactacaaccgccgtttcacccctgaaatcgcggaacgtccgaaagtgcgtgaccaggcaggccgcatgaactattactggaccctgctgaagccgggtgatactatcatcttcgaagcgaacggtaacctgatcgccccgatgtacgcgttcgctctgagccgtggcttcggctctggtatcattacgtcttaataa

SEQ ID NO: 56 - DNA, 2214 bp, Artificial Sequence
  STF2.HA1-2mut PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttagcgagcggcagtggtagcggatccaaaggtgcggctccactgcaactgggtaaatgcaatattgcgggttggctgctgggcaacccggaatgcgatccgctgctgccggtccgttcctggagcgatattgcggaaactccgaactctgagaacggcatctgctatccaggtgatttcattgactatgaggaactgcgtgaacaactgtcttccgtgtcttcctttgaacgtttcgagatttttcctaaagaatcttcttggccgaaccataacactaatggtgttaccgctgcgtgctctcatgaaggtaaatctagcttttaccgcaacctgctgtggctgaccgagaaagaaggttcttacccgaaactgaaaaacagctacgtaaacaaaaagggcaaggaagttctggtcctgtggggtatccaccatccgccgaacagcaaggaacagcagaatctgtatcagaacgaaaacgcatacgtatctgttgttacttctaactacaaccgccgtttcacccctgaaatcgcggaacgtccgaaagtgcgtgaccaggcaggccgcatgaactattactggaccctgctgaagccgggtgatactatcatcttcgaagcgaacggtaacctgatcgccccgatgtacgcgttcgctctgagccgtggcttcggctctggtatcattacgtcttaataa

SEQ ID NO: 57 - DNA, 2073 bp, Artificial Sequence
  STF2.HA1-3 PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgttctggtagcggttctggctctaactctgaaaatggtatctgttacccgggtgatttcatcgattatgaggaactgcgtgaacagctgtctagcgtgagctcctttgaacgcttcgaaatcttcccgaaggaatctagctggccgaaccataacacgaacggtgtgaccgctgcttgctcccacgaaggtaagagctccttctaccgcaatctgctgtggctgactgaaaaagaaggtagctacccgaaactgaaaaattcttacgtcaacaagaaaggcaaggaagtgctggttctgtggggcattcaccacccaccgaacagcaaagagcaacagaacctgtaccaaaatgagaacgcttacgtttctgttgtgacttctaactacaatcgtcgctttacccctgaaatcgcggagcgtccaaaagtgcgtgaccaggctggtcgtatgaactactattggaccctgctgaaaccgggcgacaccattatctttgaagcgaacggtaacctgatcgcgcctatgtacgcgttcgctctgtctcgtggctaataa

SEQ ID NO: 58 - DNA, 2073 bp, Artificial Sequence
  STF2.HA1-3mut PR8
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtagcggcagtggtagcggatccaactctgaaaatgaaatctgttacccgggtgatttcatcgataaagaggaactgcgtgaacagctgtctagcgtgagctcctttgaacgcttcgaaatcttcccgaaggaatctagctggccgaaccataacacgaacggtgtgaccgctgcttgctcccacgaaggtaagagctccttctaccgcaatctgctgtggctgactgaaaaagaaggtagctacccgaaactgaaaaattcttacgtcaacaagaaaggcaaggaagtgctggttctgtggggcattcaccacccaccgaacagcaaagagcaacagaacctgtaccaaaatgagaacgcttacgtttctgttgtgacttctaactacaatcgtcgctttacccctgaaatcgcggagcgtccaaaagtgcgtgaccaggctggtcgtatgaactactattggaccctgctgaaaccgggcgacaccattatctttgaagcgaacggtaacctgatcgcgcctatgtacgcggcggctctgtctcgtggctaataa

SEQ ID NO: 59 - DNA, 819 bp, Artificial Sequence
  HA1-1 PR8
atgtctcataacggtaaactgtgtcgtctgaaaggtattgcaccactgcagctgggcaaatgcaacatcgcgggttggctgctgggtaaccctgaatgtgacccgctgctgccggttcgttcctggagctacattgttgaaaccccgaactccgaaaacggtatctgctacccgggcgactttattgactatgaagaactgcgtgagcagctgtcttccgtgagcagctttgaacgcttcgaaatcttcccgaaggaaagctcctggccgaaccacaacactaacggcgtgacggcggcttgctcccacgaaggcaaatcttccttttatcgtaacctgctgtggctgactgaaaaggaaggttcctacccaaaactgaaaaacagctatgttaacaaaaagggtaaagaagtcctggtgctgtggggcatccaccacccgccgaactccaaggaacagcagaatctgtatcagaacgaaaacgcatacgtttctgtcgttacttccaactataaccgtcgtttcactccggaaatcgcggaacgtccgaaagtacgcgaccaggctggccgtatgaactactactggaccctgctgaaaccgggtgacactattatcttcgaagctaacggtaacctgatcgcaccaatgtacgctttcgcactgtctcgtggtttcggttccggcattatcaccagcaacgcgtctatgcacgaatgcaacacgaaatgtcagacgccgctgggcgcaattaatagcagcctgccgtaccagaacatccacccggtgactatcggcgaatgcccgaagtatgttcgt

SEQ ID NO: 60 - DNA, 837 bp, Artificial Sequence
  HA1-1.his PR8
atgtctcataacggtaaactgtgtcgtctgaaaggtattgcaccactgcagctgggcaaatgcaacatcgcgggttggctgctgggtaaccctgaatgtgacccgctgctgccggttcgttcctggagctacattgttgaaaccccgaactccgaaaacggtatctgctacccgggcgactttattgactatgaagaactgcgtgagcagctgtcttccgtgagcagctttgaacgcttcgaaatcttcccgaaggaaagctcctggccgaaccacaacactaacggcgtgacggcggcttgctcccacgaaggcaaatcttccttttatcgtaacctgctgtggctgactgaaaaggaaggttcctacccaaaactgaaaaacagctatgttaacaaaaagggtaaagaagtcctggtgctgtggggcatccaccacccgccgaactccaaggaacagcagaatctgtatcagaacgaaaacgcatacgtttctgtcgttacttccaactataaccgtcgtttcactccggaaatcgcggaacgtccgaaagtacgcgaccaggctggccgtatgaactactactggaccctgctgaaaccgggtgacactattatcttcgaagctaacggtaacctgatcgcaccaatgtacgctttcgcactgtctcgtggtttcggttccggcattatcaccagcaacgcgtctatgcacgaatgcaacacgaaatgtcagacgccgctgggcgcaattaatagcagcctgccgtaccagaacatccacccggtgactatcggcgaatgcccgaagtatgttcgtcatcaccatcatcaccat

SEQ ID NO: 61 - DNA, 690 bp, Artificial Sequence
  HA1-2.his PR8
atgaaaggtattgctccactgcaactgggtaaatgcaatattgcgggttggctgctgggcaacccggaatgcgatccgctgctgccggtccgttcctggagctatattgttgaaactccgaactctgagaacggcatctgctatccaggtgatttcattgactatgaggaactgcgtgaacaactgtcttccgtgtcttcctttgaacgtttcgagatttttcctaaagaatcttcttggccgaaccataacactaatggtgttaccgctgcgtgctctcatgaaggtaaatctagcttttaccgcaacctgctgtggctgaccgagaaagaaggttcttacccgaaactgaaaaacagctacgtaaacaaaaagggcaaggaagttctggtcctgtggggtatccaccatccgccgaacagcaaggaacagcagaatctgtatcagaacgaaaacgcatacgtatctgttgttacttctaactacaaccgccgtttcacccctgaaatcgcggaacgtccgaaagtgcgtgaccaggcaggccgcatgaactattactggaccctgctgaagccgggtgatactatcatcttcgaagcgaacggtaacctgatcgccccgatgtacgcgttcgctctgagccgtggcttcggctctggtatcattacgtctcatcaccatcatcaccat

SEQ ID NO: 62 - DNA, 2304 bp, Artificial Sequence
  CRM.HA1-2
atgggtgctgatgatgtcgttgattcctccaaaagcttcgttatggaaaatttctcttcttatcacggcaccaaaccgggttatgtggattctatccaaaaaggcatccagaaaccgaagtccggtacgcagggtaactatgatgacgattggaaaggtttttactccaccgataataaatatgacgcggctggctactctgttgacaacgaaaatccactgtctggtaaggctggcggtgtcgtaaaggtaacgtatcctggcctgaccaaggtgctggcactgaaggtggataacgctgaaaccatcaaaaaggagctgggcctgagcctgactgaaccgctgatggagcaggtcggtaccgaggaattcatcaaacgcttcggtgatggcgcctcccgtgttgtgctgtccctgccgttcgcagaaggctcttcctctgtcgaatatatcaacaactgggaacaggctaaagctctgagcgtcgaactggaaattaactttgagacccgtggcaagcgtggtcaggacgcgatgtacgaatatatggctcaggcttgtgccggtaaccgtgttcgccgttccgtcggttcctctctgtcttgcatcaacctggattgggacgttatccgtgataagaccaaaaccaaaattgaaagcctgaaggaacacggtccgatcaaaaacaaaatgtctgaatctccgaacaaaaccgtgtccgaggaaaaagcgaaacagtatctggaagaattccaccagactgccctggaacatcctgaactgtccgaactgaagactgtaaccggcactaacccggtgttcgcaggcgcaaactacgccgcgtgggcggtaaacgttgcgcaggttattgatagcgaaaccgcagataacctggaaaaaacgaccgcagctctgtctatcctgccgggtatcggttccgttatgggtattgcggacggcgctgtgcaccacaacacggaagaaatcgtcgcacagtctatcgcgctgtcttctctgatggttgctcaggcaattccactggtaggtgaactggtggacattggctttgcggcgtacaacttcgtcgaaagcattatcaacctgttccaggttgtacacaactcttacaaccgtccggcctacagccctggccacaaaacccaaccgtttctgcacgacggttatgcggtgtcctggaacacggttgaagactctatcattcgtaccggctttcagggcgagtccggccacgatatcaaaattactgcagaaaacactccgctgccgatcgctggcgttctgctgccgaccatcccgggtaagctggatgtgaacaaaagcaaaacccacatctctgttaacggtcgtaaaattcgcatgcgctgtcgtgctatcgacggtgatgttaccttctgccgtccgaaatctccagtctacgtgggcaacggtgttcatgccaacctgcacgtggcgttccatcgtagctctagcgaaaaaatccactccaacgaaatctctagcgattctatcggtgttctgggttatcagaaaacggtggatcatacgaaagtcaattctaaactgagcctgttcttcgaaatcaaatctagcggctctggatccggttccaaaggcatcgcgccgctgcagctgggtaaatgtaacattgcgggctggctgctgggtaatccggaatgcgatccgctgctgccggtccgtagctggtcttacattgttgaaactccgaactctgagaatggcatctgctacccgggcgattttatcgactatgaagaactgcgtgaacagctgtcttccgtttcttcctttgaacgtttcgaaatcttcccgaaagaaagcagctggccgaatcacaatacgaacggtgttactgctgcgtgttctcatgaaggtaaatccagcttctaccgtaacctgctgtggctgaccgaaaaagagggttcttatcctaaactgaaaaacagctacgttaacaaaaagggcaaagaagtgctggtgctgtggggtatccatcaccctccgaactctaaagaacaacagaatctgtatcagaacgaaaacgcttacgtttccgtggtgacctctaactataaccgtcgttttaccccggagattgctgaacgtccgaaagtgcgcgatcaggctggccgtatgaactactattggaccctgctgaaaccgggcgataccatcattttcgaagctaacggcaacctgattgctccgatgtatgcgtttgctctgtctcgtggcttcggctctggtattattacgtcttaataa

SEQ ID NO: 63 - DNA, 1068 bp, Artificial Sequence
  LTB.HA1-2
atgaataaggttaagttctacgtactgtttaccgcgctgctgtcttctctgtgcgcgcatggtgctccgcagtctattactgaactgtgctctgaataccacaacacccagatctatactatcaacgataaaatcctgagctataccgaatctatggcaggcaaacgcgaaatggttatcattacctttaaaagcggcgccacctttcaagtggaagttccgggctctcagcatattgactctcaaaaaaaagcgatcgaacgtatgaaagatactctgcgcattacctacctgaccgaaaccaaaatcgataaactgtgcgtatggaacaataagactcctaactctatcgcagctatttctatggaaaactctggtagcggatccggttctaaaggcatcgcgccgctgcagctgggtaaatgtaacattgcgggctggctgctgggtaatccggaatgcgatccgctgctgccggtccgtagctggtcttacattgttgaaactccgaactctgagaatggcatctgctacccgggcgattttatcgactatgaagaactgcgtgaacagctgtcttccgtttcttcctttgaacgtttcgaaatcttcccgaaagaaagcagctggccgaatcacaatacgaacggtgttactgctgcgtgttctcatgaaggtaaatccagcttctaccgtaacctgctgtggctgaccgaaaaagagggttcttatcctaaactgaaaaacagctacgttaacaaaaagggcaaagaagtgctggtgctgtggggtatccatcaccctccgaactctaaagaacaacagaatctgtatcagaacgaaaacgcttacgtttccgtggtgacctctaactataaccgtcgttttaccccggagattgctgaacgtccgaaagtgcgcgatcaggctggccgtatgaactactattggaccctgctgaaaccgggcgataccatcattttcgaagctaacggcaacctgattgctccgatgtatgcgtttgctctgtctcgtggcttcggctctggtattattacgtcttaataa

SEQ ID NO: 64 - DNA, 2346 bp, Artificial Sequence
  STF2.HA1-1 VN
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcggagaagaaacacaatggcaaactgtgtgatctggatggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagctggaatatggcaactgtaacaccaaatgccagaccccgatgggtgcaatcaactcctccatgccgtttcacaacattcacccgctgactatcggcgaatgtccgaaatacgttaaatagtaa

SEQ ID NO: 65 - DNA, 46 bp, Artificial Sequence
  FOR PRIMER
agtggctgagcctgttagcggagaagaaacacaatggcaaactgtg

SEQ ID NO: 66 - DNA, 50 bp, Artificial Sequence
  REV PRIMER
agtcgctcagcttactatttaacgtatttcggacattcgccgatagtcag

SEQ ID NO: 67 - DNA, 1605 bp, Artificial Sequence
  HA0s VN
gtgctgagcctgttacgtcagatttgtatcggctaccacgcaaacaactctaccgagcaagttgataccatcatggagaaaaacgtgaccgttactcacgcgcaggacatcctggagaagaaacacaatggcaaactgtgtgatctggatggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagctggaatatggcaactgtaacaccaaatgccagaccccgatgggtgcaatcaactcctccatgccgtttcacaacattcacccgctgactatcggcgaatgtccgaaatacgttaaatccaatcgtctggttctggctaccggtctgcgtaactccccacagcgtgaacgtcgtcgtaagaaacgtggtctgtttggcgcgatcgctggtttcatcgagggcggctggcagggtatggttgatggctggtacggttatcatcattccaatgaacagggttccggctacgccgcagataaagaaagcactcagaaagcaattgatggcgtaactaacaaagtaaattctatcattgataaaatgaacacccagttcgaggcggttggtcgtgagttcaacaacctggaacgccgtatcgaaaacctgaacaagaaaatggaagacggttttctggatgtgtggacttacaatgctgaactgctggtgctgatggaaaacgagcgtaccctggacttccacgacagcaacgtcaaaaatctgtatgacaaagtccgtctgcagctgcgtgataacgctaaagagctgggtaatggctgcttcgagttctatcacaaatgcgacaacgaatgcatggaatctgtccgcaacggcacttacgattatccgcagtactccgaagaagcgcgcctgaaacgcgaagagatctccggtgtgaagctggagtctattggcatctaccagatcctgtccatctacagcacctagtaagctgagcgcctacgcagc

SEQ ID NO: 68 - DNA, 2193 bp, Artificial Sequence
  STF2.HA1-2 VN
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcaggtgtgaaaccgctgattctgcgcgattgctctgtggcaggctggctgctgggcaaccctatgtgtgacgaattcattaacgttccggaatggtcttacattgttgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaa

SEQ ID NO: 69 - DNA, 49 bp, Artificial Sequence
  FOR PRIMER
agtcgctgagcctgttagcaggtgtgaaaccgctgattctgcgcgattg

SEQ ID NO: 70 - DNA, 48 bp, Artificial Sequence
  REV PRIMER
tgacgctcagcttactactcggatttcatgatagtgctatcacctttc

SEQ ID NO: 71 - DNA, 2193 bp, Artificial Sequence
  STF2.HA1-2mut VN
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgggtgcgaaaccgctgtctctgcgcgattgctctgtggcaggctggctgctgggcaaccctatgtgtgacgaattcattaacgttccggaatggtctgatattgccgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaa

SEQ ID NO: 72 - DNA, 675 bp, Artificial Sequence
  72 HA1-2mut VN
ggtgcgaaaccgctgtctctgcgcgattgctctgtggcaggctggctgctgggcaaccctatgtgtgacgaattcattaacgttccggaatggtctgatattgccgaaaaagctaaccctgtcaacgatctgtgttaccctggtgactttaacgattacgaagaactgaagcacctgctgtctcgtatcaatcacttcgagaaaatccagatcatcccgaaatcctcctggagctcccacgaagcttctctgggcgtatcctccgcgtgcccgtaccagggcaaatcctctttctttcgtaacgttgtttggctgatcaagaaaaactccacctacccgacgatcaagcgtagctataataacaccaaccaggaagacctgctggttctgtggggcatccaccatccaaacgatgctgcggaacagaccaagctgtaccagaacccgaccacctacatcagcgtgggcacctctacgctgaaccagcgtctggtaccgcgtatcgcaacccgcagcaaggtaaacggtcaaagcggccgcatggaatttttctggaccatcctgaaaccgaacgacgcaatcaacttcgaatctaacggcaatttcatcgctccggagtatgcgtacaaaatcgtaaagaaaggtgatagcactatcatgaaatccgagtagtaa

SEQ ID NO: 73 - DNA, 2346 bp, Artificial Sequence
  STF2.HA1-1 IND
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttagcggagaaaacgcataacggtaaactgtgcgacctggacggcgtgaagccgctgatcctgcgtgactgttctgttgctggctggctgctgggcaacccgatgtgcgatgagttcatcaacgttccggagtggtcttatattgttgaaaaagcgaacccgaccaatgacctgtgctacccgggctcttttaatgactacgaggagctgaaacatctgctgtctcgcatcaaccatttcgaaaaaattcagatcatcccgaaatcttcctggagcgatcacgaagcttcttccggcgtatcttctgcatgcccttacctgggttccccgtctttcttccgtaacgtggtttggctgatcaagaagaactctacgtacccgaccatcaagaaatcctataacaacactaaccaggaagatctgctggtgctgtggggtatccatcatccaaacgatgcagccgaacagacccgcctgtaccagaatccgaccacgtacatctctatcggcacttctaccctgaatcaacgcctggtgccgaaaatcgcaactcgcagcaaagtcaacggccaatctggtcgcatggagtttttctggaccatcctgaaaccgaacgacgcgattaacttcgaaagcaacggcaacttcattgcaccggaatatgcttacaagatcgttaaaaagggtgattctgcgatcatgaaaagcgagctggaatacggcaactgcaacactaaatgccagaccccgatgggtgcaatcaattccagcatgccatttcacaacatccacccgctgaccatcggcgagtgtccaaaatacgttaaataatag

SEQ ID NO: 74 - DNA, 46 bp, Artificial Sequence
  FOR PRIMER
agtggctgagcctgttagcggagaaaacgcataacggtaaactgtg

SEQ ID NO: 75 - DNA, 1685 bp, Artificial Sequence
  HA0s IND
gctgagcctgttacgtgatcaaatctgcatcggttaccacgcaaacaactccactgaacaagtggatacgatcatggaaaagaacgtgaccgtgacccacgctcaagatatcctggagaaaacgcataacggtaaactgtgcgacctggacggcgtgaagccgctgatcctgcgtgactgttctgttgctggctggctgctgggcaacccgatgtgcgatgagttcatcaacgttccggagtggtcttatattgttgaaaaagcgaacccgaccaatgacctgtgctacccgggctcttttaatgactacgaggagctgaaacatctgctgtctcgcatcaaccatttcgaaaaaattcagatcatcccgaaatcttcctggagcgatcacgaagcttcttccggcgtatcttctgcatgcccttacctgggttccccgtctttcttccgtaacgtggtttggctgatcaagaagaactctacgtacccgaccatcaagaaatcctataacaacactaaccaggaagatctgctggtgctgtggggtatccatcatccaaacgatgcagccgaacagacccgcctgtaccagaatccgaccacgtacatctctatcggcacttctaccctgaatcaacgcctggtgccgaaaatcgcaactcgcagcaaagtcaacggccaatctggtcgcatggagtttttctggaccatcctgaaaccgaacgacgcgattaacttcgaaagcaacggcaacttcattgcaccggaatatgcttacaagatcgttaaaaagggtgattctgcgatcatgaaaagcgagctggaatacggcaactgcaacactaaatgccagaccccgatgggtgcaatcaattccagcatgccatttcacaacatccacccgctgaccatcggcgagtgtccaaaatacgttaaatccaatcgtctggtgctggcaacgggcctgcgcaactctccgcaacgtgagtctcgtcgcaaaaagcgtggcctgtttggcgcaattgcgggcttcatcgagggcggctggcagggtatggttgatggttggtacggttatcaccattccaacgagcagggctctggttacgctgcggacaaagagtccacgcagaaagcgatcgatggcgtcaccaacaaagtgaactctatcatcgacaagatgaacactcagttcgaggctgtgggccgtgaattcaacaatctggaacgtcgcatcgaaaacctgaacaaaaagatggaagacggtttcctggacgtatggacctataacgcagagctgctggttctgatggaaaacgaacgtactctggacttccacgattctaacgttaaaaacctgtacgacaaagttcgtctgcagctgcgcgataatgcaaaagaactgggtaacggctgctttgaattttaccacaaatgtgacaacgaatgcatggaaagcatccgtaacggtacctacaattacccacagtactccgaagaagcgcgtctgaaacgtgaagaaatctccggtgtaaaactggaatccattggcacgtatcagattctgtctatctactccacggtagcgtcctctctggcgctggcaattatgatggccggcctgtctctgtggatgtgctctaacggctctctgcagtgccgcatctgcatctaataggctgagc

SEQ ID NO: 76 - DNA, 2193 bp, Artificial Sequence
  STF2.HA1-2 IND
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcaggtgtgaaaccgctgattctgcgcgattgttctgttgctggctggctgctgggcaacccgatgtgcgatgagttcatcaacgttccggagtggtcttatattgttgaaaaagcgaacccgaccaatgacctgtgctacccgggctcttttaatgactacgaggagctgaaacatctgctgtctcgcatcaaccatttcgaaaaaattcagatcatcccgaaatcttcctggagcgatcacgaagcttcttccggcgtatcttctgcatgcccttacctgggttccccgtctttcttccgtaacgtggtttggctgatcaagaagaactctacgtacccgaccatcaagaaatcctataacaacactaaccaggaagatctgctggtgctgtggggtatccatcatccaaacgatgcagccgaacagacccgcctgtaccagaatccgaccacgtacatctctatcggcacttctaccctgaatcaacgcctggtgccgaaaatcgcaactcgcagcaaagtcaacggccaatctggtcgcatggagtttttctggaccatcctgaaaccgaacgacgcgattaacttcgaaagcaacggcaacttcattgcaccggaatatgcttacaagatcgttaaaaagggtgattctgcgatcatgaaaagcgagtaatag

SEQ ID NO: 77 - DNA, 43 bp, Artificial Sequence
  REV PRIMER
agtcgctcagcctattactcgcttttcatgatcgcagaatcac

SEQ ID NO: 78 - DNA, 2193 bp, Artificial Sequence
  STF2.HA1-2mut IND
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttagcgggcgcaaagccgctgtctctgcgtgactgttctgttgctggctggctgctgggcaacccgatgtgcgatgagttcatcaacgttccggagtggtctgatattgcggaaaaagcgaacccgaccaatgacctgtgctacccgggctcttttaatgactacgaggagctgaaacatctgctgtctcgcatcaaccatttcgaaaaaattcagatcatcccgaaatcttcctggagcgatcacgaagcttcttccggcgtatcttctgcatgcccttacctgggttccccgtctttcttccgtaacgtggtttggctgatcaagaagaactctacgtacccgaccatcaagaaatcctataacaacactaaccaggaagatctgctggtgctgtggggtatccatcatccaaacgatgcagccgaacagacccgcctgtaccagaatccgaccacgtacatctctatcggcacttctaccctgaatcaacgcctggtgccgaaaatcgcaactcgcagcaaagtcaacggccaatctggtcgcatggagtttttctggaccatcctgaaaccgaacgacgcgattaacttcgaaagcaacggcaacttcattgcaccggaatatgcttacaagatcgttaaaaagggtgattctgcgatcatgaaaagcgagtaatag

SEQ ID NO: 79 - DNA, 682 bp, Artificial Sequence
  HA1-2mut IND
ggcgcaaagccgctgtctctgcgtgactgttctgttgctggctggctgctgggcaacccgatgtgcgatgagttcatcaacgttccggagtggtctgatattgcggaaaaagcgaacccgaccaatgacctgtgctacccgggctcttttaatgactacgaggagctgaaacatctgctgtctcgcatcaaccatttcgaaaaaattcagatcatcccgaaatcttcctggagcgatcacgaagcttcttccggcgtatcttctgcatgcccttacctgggttccccgtctttcttccgtaacgtggtttggctgatcaagaagaactctacgtacccgaccatcaagaaatcctataacaacactaaccaggaagatctgctggtgctgtggggtatccatcatccaaacgatgcagccgaacagacccgcctgtaccagaatccgaccacgtacatctctatcggcacttctaccctgaatcaacgcctggtgccgaaaatcgcaactcgcagcaaagtcaacggccaatctggtcgcatggagtttttctggaccatcctgaaaccgaacgacgcgattaacttcgaaagcaacggcaacttcattgcaccggaatatgcttacaagatcgttaaaaagggtgattctgcgatcatgaaaagcgagtaataggctgagc

SEQ ID NO: 80 - DNA, 2340 bp, Artificial Sequence
  STF2.HA1-1 NC
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgtcccacaacggtaaactgtgtctgctgaaaggcatcgcaccgctgcagctgggtaactgtagcgttgcaggttggatcctgggtaacccggagtgcgaactgctgatttccaaggagagctggtcttacattgtcgaaacgccgaatccggaaaacggcacttgttatccgggttacttcgccgattacgaagaactgcgtgaacaactgtcttccgtgagctctttcgaacgtttcgagatcttcccgaaagagagcagctggccaaaccacactgttaccggtgtgtctgcgagctgttctcacaacggcaagtcttctttctaccgcaacctgctgtggctgacgggtaagaatggcctgtatccgaacctgtctaaatcttacgtaaacaacaaagagaaagaggtgctggtcctgtggggcgtacaccatccaccaaatatcggcaaccagcgcgccctgtaccacaccgaaaacgcttatgtgtccgtggtgagctcccattacagccgtcgttttactccggagattgccaaacgtccgaaagttcgtgatcaggaaggccgtattaactactactggactctgctggagccgggcgataccatcattttcgaggcaaacggcaacctgattgcgccatggtacgcgttcgccctgagccgtggttttggctccggtattatcacctctaacgcgccaatggacgaatgcgacgcgaaatgccaaacgccgcagggcgcaatcaacagcagcctgccgttccagaacgttcacccggttaccatcggcgaatgccctaaatacgtgcgctaatag

SEQ ID NO: 81 - DNA, 84 bp, Artificial Sequence
  FOR PRIMER
aaccaggtcccgcagaacgtgctgagcctgttagcgtcccacaacggtaaactgtgtctgctgaaaggcatcgcaccgctgcag

SEQ ID NO: 82 - DNA, 78 bp, Artificial Sequence
  REV PRIMER
gaacagctcagttcctacgagctcagcctattagcgcacgtatttagggcattcgccgatggtaaccgggtgaacgtt

SEQ ID NO: 83 - DNA, 1653 bp, Artificial Sequence
  HA0s NC
gacacgatctgtattggttatcatgcaaacaactctactgacactgtagatactgtgctggaaaagaacgtaaccgttacccacagcgttaacctgctggaagattcccacaacggtaaactgtgtctgctgaaaggcatcgcaccgctgcagctgggtaactgtagcgttgcaggttggatcctgggtaacccggagtgcgaactgctgatttccaaggagagctggtcttacattgtcgaaacgccgaatccggaaaacggcacttgttatccgggttacttcgccgattacgaagaactgcgtgaacaactgtcttccgtgagctctttcgaacgtttcgagatcttcccgaaagagagcagctggccaaaccacactgttaccggtgtgtctgcgagctgttctcacaacggcaagtcttctttctaccgcaacctgctgtggctgacgggtaagaatggcctgtatccgaacctgtctaaatcttacgtaaacaacaaagagaaagaggtgctggtcctgtggggcgtacaccatccaccaaatatcggcaaccagcgcgccctgtaccacaccgaaaacgcttatgtgtccgtggtgagctcccattacagccgtcgttttactccggagattgccaaacgtccgaaagttcgtgatcaggaaggccgtattaactactactggactctgctggagccgggcgataccatcattttcgaggcaaacggcaacctgattgcgccatggtacgcgttcgccctgagccgtggttttggctccggtattatcacctctaacgcgccaatggacgaatgcgacgcgaaatgccaaacgccgcagggcgcaatcaacagcagcctgccgttccagaacgttcacccggttaccatcggcgaatgccctaaatacgtgcgctccgccaaactgcgcatggttactggtctgcgtaacatcccgagcattcagtctcgcggtctgttcggtgcgatcgcgggcttcattgaaggcggttggaccggtatggtggatggttggtacggctaccatcaccagaacgaacagggtagcggttacgctgccgaccagaaatccacccagaacgctattaacggtatcaccaacaaagttaacagcgtaattgagaagatgaacacgcagttcaccgccgtaggtaaggaattcaacaagctggaacgtcgcatggaaaacctgaacaaaaaggtggacgacggctttctggacatctggacctacaacgctgaactgctggtgctgctggaaaacgaacgtaccctggatttccacgactctaatgttaaaaacctgtacgaaaaggtcaagtctcaactgaaaaacaatgcgaaggaaatcggcaacggctgtttcgaattctaccataaatgcaacaacgaatgcatggaatccgttaaaaacggtacctatgactaccctaaatactccgaagaaagcaaactgaaccgcgagaaaatcgatggtgtaaaactggaatctatgggtgtttaccagatcctggcgatctactccacggtagccagcagcctggttctgctggttagcctgggtgcaattagcttctggatgtgctctaacggcagcctgcaatgccgcatctgtaataggctgagc

SEQ ID NO: 84 - DNA, 2193 bp, Artificial Sequence
  STF2HA1-2 NC
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgaaaggcatcgcaccgctgcagctgggtaactgtagcgttgcaggttggatcctgggtaacccggagtgcgaactgctgatttccaaggagagctggtcttacattgtcgaaacgccgaatccggaaaacggcacttgttatccgggttacttcgccgattacgaagaactgcgtgaacaactgtcttccgtgagctctttcgaacgtttcgagatcttcccgaaagagagcagctggccaaaccacactgttaccggtgtgtctgcgagctgttctcacaacggcaagtcttctttctaccgcaacctgctgtggctgacgggtaagaatggcctgtatccgaacctgtctaaatcttacgtaaacaacaaagagaaagaggtgctggtcctgtggggcgtacaccatccaccaaatatcggcaaccagcgcgccctgtaccacaccgaaaacgcttatgtgtccgtggtgagctcccattacagccgtcgttttactccggagattgccaaacgtccgaaagttcgtgatcaggaaggccgtattaactactactggactctgctggagccgggcgataccatcattttcgaggcaaacggcaacctgattgcgccatggtacgcgttcgccctgagccgtggttttggctccggtattatcacctcttaataa

SEQ ID NO: 85 - DNA, 84 bp, Artificial Sequence
  FOR PRIMER
aaccaggtcccgcagaacgtgctgagcctgttagcgaaaggcatcgcaccgctgcagctgggtaactgtagcgttgcaggttgg

SEQ ID NO: 86 - DNA, 84 bp, Artificial Sequence
  REV PRIMER
gaacagctcagttcctacgagctcagcctattaagaggtgataataccggagccaaaaccacggctcagggcgaacgcgtacca

SEQ ID NO: 87 - DNA, 2193 bp, Artificial Sequence
  STF2.HA1-2mut NC
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgagcctgttagcgaaaggcgcggcaccgctgcagctgggtaactgtagcgttgcaggttggatcctgggtaacccggagtgcgaactgctgatttccaaggagagctggtctgatattgcagaaacgccgaatccggaaaacggcacttgttatccgggttacttcgccgattacgaagaactgcgtgaacaactgtcttccgtgagctctttcgaacgtttcgagatcttcccgaaagagagcagctggccaaaccacactgttaccggtgtgtctgcgagctgttctcacaacggcaagtcttctttctaccgcaacctgctgtggctgacgggtaagaatggcctgtatccgaacctgtctaaatcttacgtaaacaacaaagagaaagaggtgctggtcctgtggggcgtacaccatccaccaaatatcggcaaccagcgcgccctgtaccacaccgaaaacgcttatgtgtccgtggtgagctcccattacagccgtcgttttactccggagattgccaaacgtccgaaagttcgtgatcaggaaggccgtattaactactactggactctgctggagccgggcgataccatcattttcgaggcaaacggcaacctgattgcgccatggtacgcgttcgccctgagccgtggttttggctccggtattatcacctcttaatag

SEQ ID NO: 88 - DNA, 698 bp, Artificial Sequence
  HA1-2mut NC
gctgagcctgttagcgaaaggcgcggcaccgctgcagctgggtaactgtagcgttgcaggttggatcctgggtaacccggagtgcgaactgctgatttccaaggagagctggtctgatattgcagaaacgccgaatccggaaaacggcacttgttatccgggttacttcgccgattacgaagaactgcgtgaacaactgtcttccgtgagctctttcgaacgtttcgagatcttcccgaaagagagcagctggccaaaccacactgttaccggtgtgtctgcgagctgttctcacaacggcaagtcttctttctaccgcaacctgctgtggctgacgggtaagaatggcctgtatccgaacctgtctaaatcttacgtaaacaacaaagagaaagaggtgctggtcctgtggggcgtacaccatccaccaaatatcggcaaccagcgcgccctgtaccacaccgaaaacgcttatgtgtccgtggtgagctcccattacagccgtcgttttactccggagattgccaaacgtccgaaagttcgtgatcaggaaggccgtattaactactactggactctgctggagccgggcgataccatcattttcgaggcaaacggcaacctgattgcgccatggtacgcgttcgccctgagccgtggttttggctccggtattatcacctcttaataggctgagc

SEQ ID NO: 89 - protein, 784 aa, Artificial Sequence
  STF2.HA1-1his (PR8)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRHHHHHH

SEQ ID NO: 90 - protein, 729 aa, Artificial Sequence
  STF2.HA1-2 (PR8)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 91 - protein, 729 aa, Artificial Sequence
  STF2.HA1-2mut (PR8)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGAAPLQLGKCNIAGWLLGNPECDPLLPVRSWSDIAETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITS

SEQ ID NO: 92 - protein, 682 aa, Artificial Sequence
  STF2.HA1-3 (PR8)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLANSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRG

SEQ ID NO: 93 - protein, 229 aa, Artificial Sequence
  HA1-2his (PR8)
KGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSHHHHHH

SEQ ID NO: 94 - protein, 611 aa, Artificial Sequence
  STF2.4xM2e
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 95 - protein, 729 aa, Artificial Sequence
  STF2.HA1-2 (VN)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 96 - protein, 506 aa, Artificial Sequence
  STF2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 97 - DNA, 1614 bp, Artificial Sequence
  STF2.B1p.wt
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactacgagagttcagtcgttacccagcccaatggcggccgctc

SEQ ID NO: 98 - DNA, 1569 bp, Artificial Sequence
  STF2.B1p.ng
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcagctctctgaagctaggtctcgtattgaggattccgattacgctaccgaggtctcccagatgtcccgtgcccaaattctccaacaagccggcacctccgtcctcgcccaagccaatcaggtgccacagaatgtgctgagc

SEQ ID NO: 99 - DNA, 63 bp, Artificial Sequence
  Honey Bee mellitin
atgaaattcttagtcaacgttgcccttgtttttatggtcgtatacatttcttacatctatgcg

SEQ ID NO: 100 - DNA, 3156 bp, Artificial Sequence
  STF2.HA0s
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcatcaggttccggctcaggttccgacaccatttgcattggataccatgcaaacaactcaaccgatactgttgataccgtccttgagaagaacgttaccgtcacgcactcggtcaacctattagaggatagccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagatccgccaagttgcggatggtgaccggcctccgcaatattcctagtattcagtcacgcggcttgttcggcgccatcgctggtttcatcgaaggcgggtggacaggcatgattgatggctggtatggctatcaccaccagaacgagcagggctcgggctacgcggctgaccagaagtcgactcagaatgccatcaatggcatcacgaataaggtgaacacggtcattgaaaagatgaacattcaatttacagccgtaggaaaagagtttaataaactggaaaaaagaatggagaatctgaataagaaggtggacgacggatttttggacatctggacgtacaacgccgagctgctggttctgctggaaaatgagcgaacactggattttcatgattctaacgtaaagaatctgtacgagaaggtgaagtcccaactaaagaataatgccaaggaaatcggaaatggatgctttgagttttaccacaagtgcgataatgagtgcatggaatccgtgcgaaatggtacatacgattacccaaagtactccgaagaatccaagctaaatcgcgaaaaggttgatggtgttaaacttgaatccatgggtatttaccaacaccatcatcaccaccattaatag

SEQ ID NO: 101 - DNA, 67 bp, Artificial Sequence
  FOR PRIMER
agtcgctgagcctactagcatcaggttccggctcaggttccgacaccatttgcattggataccatgc

SEQ ID NO: 102 - DNA, 55 bp, Artificial Sequence
  REV PRIMER
agtcgcatgcctattaatggtggtgatgatggtgttggtaaatacccatggattc

SEQ ID NO: 103 - DNA, 1557 bp, Artificial Sequence
  HA0s PR8
gacaccatttgcattggataccatgcaaacaactcaaccgatactgttgataccgtccttgagaagaacgttaccgtcacgcactcggtcaacctattagaggatagccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagatccgccaagttgcggatggtgaccggcctccgcaatattcctagtattcagtcacgcggcttgttcggcgccatcgctggtttcatcgaaggcgggtggacaggcatgattgatggctggtatggctatcaccaccagaacgagcagggctcgggctacgcggctgaccagaagtcgactcagaatgccatcaatggcatcacgaataaggtgaacacggtcattgaaaagatgaacattcaatttacagccgtaggaaaagagtttaataaactggaaaaaagaatggagaatctgaataagaaggtggacgacggatttttggacatctggacgtacaacgccgagctgctggttctgctggaaaatgagcgaacactggattttcatgattctaacgtaaagaatctgtacgagaaggtgaagtcccaactaaagaataatgccaaggaaatcggaaatggatgctttgagttttaccacaagtgcgataatgagtgcatggaatccgtgcgaaatggtacatacgattacccaaagtactccgaagaatccaagctaaatcgcgaaaaggttgatggtgttaaacttgaatccatgggtatttaccaacaccatcatcaccaccattaatag

SEQ ID NO: 104 - DNA, 2439 bp, Artificial Sequence
  STF2.HA1-1
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcatcaggttccggctcaggttccagccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagacaccatcatcaccaccattaatag

SEQ ID NO: 105 - DNA, 66 bp, Artificial Sequence
  FOR PRIMER
agtcgctgagcctactagcatcaggttccggctcaggttccagccacaacggaaagctgtgccgtc

SEQ ID NO: 106 - DNA, 67 bp, Artificial Sequence
  REV PRIMER
agtcgcatgcctattaatggtggtgatgatggtgtctgacatatttgggacactcgcctatggtgac

SEQ ID NO: 107 - DNA, 2292 bp, Artificial Sequence
  STF2.HA1-2
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatgggataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaacgagattgaccgggtgagcggtcagacacagtttaacggcgtgaaggtacttgcgcaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcatcaggttccggctcaggttccaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgagaggttcgaaatcttcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgcgttcgccctgagccgtggctttggatcggggatcatcacgtctcaccatcatcaccaccattaatag

SEQ ID NO: 108 - DNA, 66 bp, Artificial Sequence
  FOR PRIMER
agtcgctgagcctactagcatcaggttccggctcaggttccaaaggcatagcgccactgcagctcg

SEQ ID NO: 109 - DNA, 70 bp, Artificial Sequence
  REV PRIMER
agtcgcatgcctattaatggtggtgatgatggtgagacgtgatgatccccgatccaaagccacggctcag

SEQ ID NO: 110 - DNA, 2292 bp, Artificial Sequence
  STF2.HA1-2mut
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctgctggcttctggatctggatctggttctaaaggcgctgcccctctgcaactcggcaagtgcaatattgcggggtggctgttgggcaacccagaatgtgaccccctcctgcccgtccgttcttggtctgacatcgctgaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaccaccaccaccaccactaatag

SEQ ID NO: 111 - DNA, 692 bp, Artificial Sequence
  HA1-2mut
aaggcgctgcccctctgcaactcggcaagtgcaatattgcggggtggctgttgggcaacccagaatgtgaccccctcctgcccgtccgttcttggtctgacatcgctgaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaccaccaccaccaccactaatag

SEQ ID NO: 112 - DNA, 2151 bp, Artificial Sequence
  STF2.HA1-3
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatgggataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaacgagattgaccgggtgagcggtcagacacagtttaacggcgtgaaggtacttgcgcaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcatcaggttccggctcaggttccaatagcgagaacggaatttgctacccaggagatttcatagactacgaggagttgcgcgagcagctttcgtctgtgagcagcttcgagaggttcgaaatcttcccgaaggagagcagctggccgaatcataacactaacggtgtgacagccgcctgcagtcatgaaggaaagagttcattctatcgcaacctgctgtggttgacggagaaggagggcagctaccctaagctgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggccaccatcatcaccaccattaatag

SEQ ID NO: 113 - DNA, 66 bp, Artificial Sequence
  FOR PRIMER
agtcgctgagcctactagcatcaggttccggctcaggttccaatagcgagaacggaatttgctacc

SEQ ID NO: 114 - DNA, 54 bp, Artificial Sequence
  REV PRIMER
agtcgcatgcctattaatggtggtgatgatggtggccacggctcagggcgaagg

SEQ ID NO: 115 - DNA, 2151 bp, Artificial Sequence
  STF2.HA1-3mut
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgcgttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcctccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctgctggcttctggatctggatctggttctaactccgagaacgaaatctgttacccgggcgacttcattgacaaagaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctgctgctctctctcgcggacaccaccaccaccaccactaatag

SEQ ID NO: 116 - DNA, 552 bp, Artificial Sequence
  HA1-3mut PR8
aactccgagaacgaaatctgttacccgggcgacttcattgacaaagaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctgctgctctctctcgcggacaccaccaccaccaccactaatag

SEQ ID NO: 117 - DNA, 3156 bp, Artificial Sequence
  ngSTF2.HA0s
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcaactctctgaagctaggtctcgtattgaggattccgattacgctaccgaggtctcccagatgtcccgtgcccaaattctccaacaagccggcacctccgtcctcgcccaagccaatcaggtgccacagaatgtgctgagcctgctggcttctggatctggatctggttctgacaccatctgcattggctaccatgcccagcagtctacagatacagtcgataccgtcctggagaaacaagtcaccgtcacgcactccgtgaacctcctggaggactcccataatggcaaattgtgtcggctgaaaggcatcgcccctctgcaactcggcaagtgcaatattgcggggtggctgttgggcaacccagaatgtgaccccctcctgcccgtccgttcttggtcttacatcgtggaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaagcctccatgcacgagtgcaataccaagtgtcaaactccactgggagccattcaaagctccctgccctaccaaaacatccatcctgtgaccattggagagtgccctaaatacgtgcgcagcgcgaaactgcgcatggtgaccggtctccgcaatataccctccatacaatcgcgcggcctgtttggtgctatcgctggctttatcgagggaggatggactggaatgatcgacggctggtatggctatcatcatcaaaacgaacagggttccggctacgccgctgaccaaaagtccactcaaaacgccattaacggtattacaaacaaagtaaacaccgtgatagagaaaatgaatatccaattcactgccgtgggcaaagagtttaacaagctggagaagcgcatggaaaatctgaacaaaaaagtcgatgatggcttcctcgacatctggacttacaacgccgaactcctcgtgctgctcgaaaacgagaggactctggacttccacgactccaacgtgaagaacctgtacgagaaagtcaaatcccaactcaagaacaacgccaaagaaatcggcaacggctgcttcgagttctaccacaaatgtgataacgagtgtatggaatccgtacggcaaggcacttacgactaccccaaatacagcgaagagagcaaattgaaccgcgagaaagtggacggcgtgaaactggagtccatgggcatctatcagcaccaccaccaccaccactaatag

SEQ ID NO: 118 - DNA, 1557 bp, Artificial Sequence
  ngHA0s
gacaccatctgcattggctaccatgcccagcagtctacagatacagtcgataccgtcctggagaaacaagtcaccgtcacgcactccgtgaacctcctggaggactcccataatggcaaattgtgtcggctgaaaggcatcgcccctctgcaactcggcaagtgcaatattgcggggtggctgttgggcaacccagaatgtgaccccctcctgcccgtccgttcttggtcttacatcgtggaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaagcctccatgcacgagtgcaataccaagtgtcaaactccactgggagccattcaaagctccctgccctaccaaaacatccatcctgtgaccattggagagtgccctaaatacgtgcgcagcgcgaaactgcgcatggtgaccggtctccgcaatataccctccatacaatcgcgcggcctgtttggtgctatcgctggctttatcgagggaggatggactggaatgatcgacggctggtatggctatcatcatcaaaacgaacagggttccggctacgccgctgaccaaaagtccactcaaaacgccattaacggtattacaaacaaagtaaacaccgtgatagagaaaatgaatatccaattcactgccgtgggcaaagagtttaacaagctggagaagcgcatggaaaatctgaacaaaaaagtcgatgatggcttcctcgacatctggacttacaacgccgaactcctcgtgctgctcgaaaacgagaggactctggacttccacgactccaacgtgaagaacctgtacgagaaagtcaaatcccaactcaagaacaacgccaaagaaatcggcaacggctgcttcgagttctaccacaaatgtgataacgagtgtatggaatccgtacggcaaggcacttacgactaccccaaatacagcgaagagagcaaattgaaccgcgagaaagtggacggcgtgaaactggagtccatgggcatctatcagcaccaccaccaccaccactaatag

SEQ ID NO: 119 - DNA, 2439 bp, Artificial Sequence
  ngSTF2.HA1-1
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcagctctctgaagctaggtctcgtattgaggattccgattacgctaccgaggtctcccagatgtcccgtgcccaaattctccaacaagccggcacctccgtcctcgcccaagccaatcaggtgccacagaatgtgctgagcctgctggcttctggatctggatctggttcttcccataatggcaaattgtgtcggctgaaaggcatcgcccctctgcaactcggcaagtgcaatattgcggggtggctgttgggcaacccagaatgtgaccccctcctgcccgtccgttcttggtcttacatcgtggaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaagcctccatgcacgagtgcaataccaagtgtcaaactccactgggagccattcaaagctccctgccctaccaaaacatccatcctgtgaccattggagagtgccctaaatacgtgcgccaccaccaccaccaccactaatag

SEQ ID NO: 120 - DNA, 840 bp, Artificial Sequence
  ng HA1-1
tcccataatggcaaattgtgtcggctgaaaggcatcgcccctctgcaactcggcaagtgcaatattgcggggtggctgttgggcaacccagaatgtgaccccctcctgcccgtccgttcttggtcttacatcgtggaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaagcctccatgcacgagtgcaataccaagtgtcaaactccactgggagccattcaaagctccctgccctaccaaaacatccatcctgtgaccattggagagtgccctaaatacgtgcgccaccaccaccaccaccactaatag

SEQ ID NO: 121 - DNA, 2292 bp, Artificial Sequence
  ngSTF2.HA1-2
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcagctctctgaagctaggtctcgtattgaggattccgattacgctaccgaggtctcccagatgtcccgtgcccaaattctccaacaagccggcacctccgtcctcgcccaagccaatcaggtgccacagaatgtgctgagcctactagcatcaggttccggctcaggttccaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgagaggttcgaaatcttcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgcgttcgccctgagccgtggctttggatcggggatcatcacgtctcaccatcatcaccaccattaatag

SEQ ID NO: 122 - DNA, 693 bp, Artificial Sequence
  ng HA1-2
aaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctcaccatcatcaccaccattaatag

SEQ ID NO: 123 - DNA, 2292 bp, Artificial Sequence
  ngSTF2.HA1-2mut
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcagctctctgaagctaggtctcgtattgaggattccgattacgctaccgaggtctcccagatgtcccgtgcccaaattctccaacaagccggcacctccgtcctcgcccaagccaatcaggtgccacagaatgtgctgagcctgctggcttctggatctggatctggttctaaaggcgctgcccctctgcaactcggcaagtgcaatattgcggggtggctgttgggcaacccagaatgtgaccccctcctgcccgtccgttcttggtctgacatcgctgaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaccaccaccaccaccactaatag

SEQ ID NO: 124 - DNA, 693 bp, Artificial Sequence
  ngHA1-2mut
aaaggcgctgcccctctgcaactcggcaagtgcaatattgcggggtggctgttgggcaacccagaatgtgaccccctcctgcccgtccgttcttggtctgacatcgctgaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaccaccaccaccaccactaatag

SEQ ID NO: 125 - DNA, 2151 bp, Artificial Sequence
  ngSTF2.HA1-3
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcagctctctgaagctaggtctcgtattgaggattccgattacgctaccgaggtctcccagatgtcccgtgcccaaattctccaacaagccggcacctccgtcctcgcccaagccaatcaggtgccacagaatgtgctgagcctactagcatcaggttccggctcaggttccaatagcgagaacggaatttgctacccaggagatttcatagactacgaggagttgcgcgagcagctttcgtctgtgagcagcttcgagaggttcgaaatcttcccgaaggagagcagctggccgaatcataacactaacggtgtgacagccgcctgcagtcatgaaggaaagagttcattctatcgcaacctgctgtggttgacggagaaggagggcagctaccctaagctgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggccaccatcatcaccaccattaatag

SEQ ID NO: 126 - DNA, 552 bp, Artificial Sequence
  ngHA1-3
aatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggccaccatcatcaccaccattaatag

SEQ ID NO: 127 - DNA, 2151 bp, Artificial Sequence
  ngSTF2.HA1-3mut
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcagctctctgaagctaggtctcgtattgaggattccgattacgctaccgaggtctcccagatgtcccgtgcccaaattctccaacaagccggcacctccgtcctcgcccaagccaatcaggtgccacagaatgtgctgagcctgctggcttctggatctggatctggttctaactccgagaacgaaatctgttacccgggcgacttcattgacaaagaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctgctgctctctctcgcggacaccaccaccaccaccactaatag

SEQ ID NO: 128 - DNA, 552 bp, Artificial Sequence; identical to SEQ ID NO: 116
  ngHA1-3mut

SEQ ID NO: 129 - DNA, 2439 bp, Artificial Sequence
  wtSTF2.HA1-1ng
atgaaattcttagtcaacgttgcccttgtttttatggtcgtatacatttcttacatctatgcggcccaggttatcaataccaactccctgtcgttgctcacccaaaataaccttaataaaagccagagcgcactgggaaccgccatagaacgcctctcaagcggcctccggatcaattctgcaaaagacgacgccgccggtcaggccatcgcaaaccgctttaccgccaatatcaagggactgacgcaggcttcgaggaatgctaacgatggaataagcatcgctcaaaccacggagggcgccctgaacgagatcaacaacaacctacagcgcgtcagggagctcgcagtgcagtccgccaattcgaccaactcgcagtcggacctggactcgatccaagccgaaatcacccagcgcctgaatgagattgaccgggtgagcggtcagacacagtttaacggcgtgaaggtacttgcacaggataacacacttacgatacaggtgggcgccaacgatggtgaaaccatagacattgatctcaaacagattaacagccagacgctcgggttggatagcctgaatgtgcaaaaggcgtacgacgtgaaagacacggcggtcactaccaaagcctacgctaacaatggcactaccttggatgtgagcggattggatgatgcagcaatcaaggctgctaccggcggtacgaacggaaccgcgtccgtgaccggcggtgccgtgaagttcgatgctgacaacaataagtatttcgtcaccattggaggctttactggcgccgacgcagcaaagaacggcgactatgaagtgaacgtggcaaccgatggaaccgtgacgctggccgctggtgccaccaagaccaccatgccagccggcgccacaactaagaccgaggtgcaggagttaaaggacacccccgcggtggttagcgcagatgccaaaaacgccttgatcgccggcggagtggatgcaactgatgctaatggtgcggagctggttaaaatgtcgtatacagacaagaatggtaagacgatcgagggcggttatgcccttaaggcaggagataagtattacgctgctgattacgatgaggcgacgggagctattaaggccaagacaacgtcatacacggcggcggacggaacgactaagacggctgccaatcagttgggaggggttgacgggaagacagaggtcgttacgatcgatggcaagacatacaacgcttccaaggccgctggccacgatttcaaagctcaacccgaactggccgaggccgcggcgaaaacaactgagaacccgttgcagaagattgatgcggccctggcgcaagtagatgccctgcgctcagacctgggcgccgttcaaaatcgattcaattccgcgattacaaacctgggcaatacagtaaacaatctatccgaggccagatcccgcattgaagactccgactacgcgacagaagtaagtaacatgagtcgtgcccagattctgcagcaggccggcactagtgtcctggcccaggccaatcaagtcccgcagaatgtgctgagcctactagcatctggatctggatctggttcttcccataatggcaaattgtgtcggctgaaaggcatcgcccctctgcaactcggcaagtgcaatattgcggggtggctgttgggcaacccagaatgtgaccccctcctgcccgtccgttcttggtcttacatcgtggaaacacctaactccgagaacggcatctgttacccgggcgacttcattgactacgaggagctccgcgaacagctgtcttctgtctcttctttcgaacgtttcgaaattttcccaaaggaatcctcctggccaaaccataacaccaacggagtgaccgccgcctgtagccatgagggcaagtcttctttctaccgtaatctgctgtggctgactgaaaaagagggttcttatcccaaactgaagaactcttatgtcaacaagaagggcaaagaggtcctggtgctgtggggtatccaccacccccccaactccaaggagcagcagaatctgtaccaaaacgaaaatgcttacgtgtctgtcgtgacatctaactacaaccggcgcttcacgcccgaaatcgccgagcgtcccaaagtgcgcgatcaggccggaaggatgaactactactggaccctgctcaaacccggagataccatcatattcgaagccaatggcaatctcatcgctcccatgtatgctttcgctctctctcgcggattcggttccggcataatcactagccaagcctccatgcacgagtgcaataccaagtgtcaaactccactgggagccattcaaagctccctgccctaccaaaacatccatcctgtgaccattggagagtgccctaaatacgtgcgccaccaccaccaccaccactaatag

SEQ ID NO: 130 - DNA, 840 bp, Artificial Sequence; identical to SEQ ID NO: 120
  ngHA1-1

SEQ ID NO: 131 - DNA, 2439 bp, Artificial Sequence
  ngSTF2.HA1-1wt
atgaaattcttagtcaacgttgcccttgtttttatggtcgtatacatttcttacatctatgcggcccaagtgatcaacaccaactccctgtccctgctcactcaaaacaacctccagaaatctcagtctgctctcggtactgctatcgagcgtctctcctccggcctgaggatcaactccgctaaagatgacgccgccggacaagctatcgctaaccgctttactgccaacattaaaggcctgacccaagcctctaggaacgccaatgatggcatttctatcgctcaaaccaccgaaggcgccctgaacgaaatcaataataacctgcaacgtgtccgcgaactcgccgtccagtccgcccaatctaccaactctcagtctgacctggactctatccaagctgagatcacccaaaggctcaacgagatcgatcgtgtgtctggtcaaactcagtttaacggcgtcaaagtgctggctcaagacaacacactcaccatccaagtaggagccaatgacggcgagacaatcgatatcgacctgaagcagatcaattctcaaactctgggcctggactccctgaacgtccaaaaggcttacgacgtgaaggacaccgctgtgacaaccaaagcctatgctaatcaaggaacaaccctggacgtgtccggactcgatgacgccgctatcaaggccgctactggcggcactcagggaactgcctctgtgaccggaggcgctgtgaagttcgacgccgataacaacaaatacttcgtcactattggtggtttcactggcgctgacgccgctaagaacggtgactacgaggtcaacgtcgccactgacggaacagtgacactggccgctggcgctaccaagaccacaatgcctgctggtgctactactaagacagaggtgcaggaactcaaggacacccctgccgtggtgtccgccgatgctaagaacgctctcattgctggtggtgtcgacgctacggacgccaacggagccgagcttgtgaaaatgtcctacaccgacaagaacggaaagactatcgagggaggttacgctctgaaggctggcgataagtactacgccgctgattatgacgaagctacaggcgccattaaagctaaaaccacatcttataccgctgccgatggtactaccaagactgctgccaatcagctgggtggagtcgatggaaaaaccgaagtggtcacaatcgacggaaagacctatcaagcctccaaggctgctggccacgacttcaaggcccaacccgaactggccgaggctgctgctaaaaccactgaaaaccccctgcagaaaattgacgctgccctggcccaagtggatgccctccgctccgacctcggcgctgtgcaaaaccgcttcaactccgctattacaaacctcggcaataccgtcaatcagctctctgaagctaggtctcgtattgaggattccgattacgctaccgaggtctcccagatgtcccgtgcccaaattctccaacaagccggcacctccgtcctcgcccaagccaatcaggtgccacagaatgtgctgagcctactagcatcaggttccggctcaggttccagccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgagaggttcgaaatcttcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgcgttcgccctgagccgcggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagacaccatcatcaccaccattaatag

SEQ ID NO: 132 - DNA, 840 bp, Artificial Sequence
  HA1-1 PR8
agccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagacaccatcatcaccaccattaatag

SEQ ID NO: 133 - DNA, 903 bp, Artificial Sequence
  HA1-1 PR8
atgaaattcttagtcaacgttgcccttgtttttatggtcgtatacatttcttacatctatgcgagccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagacaccatcatcaccaccattaatag

SEQ ID NO: 134 - DNA, 105 bp, Artificial Sequence
  FOR PRIMER
aggcagatctatgaaattcttagtcaacgttgcccttgtttttatggtcgtatacatttcttacatctatgcgagccacaacggaaagctgtgccgtctgaaagg

SEQ ID NO: 135 - DNA, 55 bp, Artificial Sequence
  REV PRIMER
acctgcatgcctattaatggtggtgatgatggtgtctgacatatttgggacactc

SEQ ID NO: 136 - DNA, 1620 bp, Artificial Sequence
  HA0s PR8
atgaaattcttagtcaacgttgcccttgtttttatggtcgtatacatttcttacatctatgcggacaccatttgcattggataccatgcaaacaactcaaccgatactgttgataccgtccttgagaagaacgttaccgtcacgcactcggtcaacctattagaggatagccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagatccgccaagttgcggatggtgaccggcctccgcaatattcctagtattcagtcacgcggcttgttcggcgccatcgctggtttcatcgaaggcgggtggacaggcatgattgatggctggtatggctatcaccaccagaacgagcagggctcgggctacgcggctgaccagaagtcgactcagaatgccatcaatggcatcacgaataaggtgaacacggtcattgaaaagatgaacattcaatttacagccgtaggaaaagagtttaataaactggaaaaaagaatggagaatctgaataagaaggtggacgacggatttttggacatctggacgtacaacgccgagctgctggttctgctggaaaatgagcgaacactggattttcatgattctaacgtaaagaatctgtacgagaaggtgaagtcccaactaaagaataatgccaaggaaatcggaaatggatgctttgagttttaccacaagtgcgataatgagtgcatggaatccgtgcgaaatggtacatacgattacccaaagtactccgaagaatccaagctaaatcgcgaaaaggttgatggtgttaaacttgaatccatgggtatttaccaacaccatcatcaccaccattaatag

SEQ ID NO: 137 - DNA, 885 bp, Artificial Sequence
  HA1-1 PR8 (no his tag)
atgaaattcttagtcaacgttgcccttgtttttatggtcgtatacatttcttacatctatgcgagccacaacggaaagctgtgccgtctgaaaggcatagcgccactgcagctcggcaaatgtaacatcgcaggttggctccttggtaacccggagtgcgaccccctcctccctgtacgatcctggagttatatcgtggagacccccaatagcgagaacggaatttgctacccaggagatttcatagactacgaggagttgcgcgagcagctttcgtctgtgagcagcttcgaaaggttcgagatattcccgaaggagagcagctggccgaatcataacactaacggtgtgacagccgcctgcagtcatgaaggaaagagttcattctatcgcaacctgctgtggttgacggagaaagagggcagctaccctaagttgaagaactcctatgtgaacaaaaaaggcaaggaggttctggtgctgtggggcatacaccacccccccaatagcaaggagcagcagaatctgtaccaaaacgagaatgcctatgtgagcgtggtcactagtaactataaccgtcggttcactcccgagatcgccgagcgtccgaaggtgagggaccaggcaggccggatgaactactactggaccctattgaagccaggggacacgattatcttcgaggcaaacggaaacctcatagcgccgatgtacgccttcgccctgagccgtggctttggatcggggatcatcacgtctaacgcctcgatgcacgaatgtaataccaaatgccagaccccactgggtgctatcaactcgtccttaccctatcaaaatatacatccggtcaccataggcgagtgtcccaaatatgtcagataatag

SEQ ID NO: 138 - DNA, 45 bp, Artificial Sequence
  REV PRIMER
acctgcatgcctattatctgacatatttgggacactcgcctatgg

SEQ ID NO: 139 - DNA, 903 bp, Artificial Sequence
  HA1-1 NC
atgaaattcttagtcaacgttgcccttgtttttatggtcgtatacatttcttacatctatgcgagccacaatggtaagctgtgtctgttgaagggaattgcacccctccaactgggcaactgttcggtcgctggttggatcctcggaaacccagaatgcgagctccttatcagtaaggaatcttggtcttatattgtcgaaaccccgaaccccgagaacggaacatgctacccgggttactttgctgattacgaagagcttcgcgagcaactcagctccgtatcctccttcgagcgcttcgagatttttcccaaagagtccagctggccaaatcataccgtcaccggcgtgtcggcctcctgttcccacaacggaaagtctagcttctatagaaatcttctctggctgacgggtaagaatggtctttaccccaatttgagcaagtcctacgtcaacaacaaagaaaaggaagttctggtattgtggggtgtgcaccaccctccgaacatcggcaatcagcgcgccctgtatcacacagagaacgcgtatgtttccgttgtctcctcacattactcgaggcgcttcactcctgaaatagctaagcgtccgaaagtgcgtgaccaggagggacgtatcaactattattggacgctgttggagccaggcgatacaattatcttcgaggctaacggtaaccttatcgctccctggtacgccttcgccctgtcgcgtggtttcggtagtggaataatcactagtaatgctcctatggacgagtgtgacgctaagtgccaaacacctcagggcgctatcaatagctcccttccattccagaacgtccatccggttaccattggagagtgtccaaagtacgtgagacaccatcatcaccatcactaatag

SEQ ID NO: 140 - DNA, 103 bp, Artificial Sequence
  FOR PRIMER
aggcagatctatgaaattcttagtcaacgttgcccttgtttttatggtcgtatacatttcttacatctatgcgagccacaatggtaagctgtgtctgttgaag

SEQ ID NO: 141 - DNA, 63 bp, Artificial Sequence
  REV PRIMER
agtcgcatgcctattaatggtggtgatgatggtgtctcacgtactttggacactctccaatgg

SEQ ID NO: 142 - DNA, 1632 bp, Artificial Sequence
  HA0s NC
agatctatgaagtttctcgtgaacgttgcactggtgtttatggtagtctatatatcgtacatttatgctgacacgatttgcatcggttaccatgcgaacaactccacggataccgtggacacagtgttggaaaagaacgtgaccgtcacgcactccgtaaaccttctggaggacagccacaatggtaagctgtgtctgttgaagggaattgcacccctccaactgggcaactgttcggtcgctggttggatcctcggaaacccagaatgcgagctccttatcagtaaggaatcttggtcttatattgtcgaaaccccgaaccccgagaacggaacatgctacccgggttactttgctgattacgaagagcttcgcgagcaactcagctccgtatcctccttcgagcgcttcgagatttttcccaaagagtccagctggccaaatcataccgtcaccggcgtgtcggcctcctgttcccacaacggaaagtctagcttctatagaaatcttctctggctgacgggtaagaatggtctttaccccaatttgagcaagtcctacgtcaacaacaaagaaaaggaagttctggtattgtggggtgtgcaccaccctccgaacatcggcaatcagcgcgccctgtatcacacagagaacgcgtatgtttccgttgtctcctcacattactcgaggcgcttcactcctgaaatagctaagcgtccgaaagtgcgtgaccaggagggacgtatcaactattattggacgctgttggagccaggcgatacaattatcttcgaggctaacggtaaccttatcgctccctggtacgccttcgccctgtcgcgtggtttcggtagtggaataatcactagtaatgctcctatggacgagtgtgacgctaagtgccaaacacctcagggcgctatcaatagctcccttccattccagaacgtccatccggttaccattggagagtgtccaaagtacgtgagatcggccaaacttcgcatggtcacgggtctgcgcaacatcccgtcaatccaatctaggggcctcttcggcgctatcgccggtttcattgagggcggttggactggaatggttgacggatggtacggctatcatcaccagaacgaacaaggttccggttacgctgctgaccagaaatctactcagaacgcgatcaatggtatcacgaacaaggtgaacagcgtcattgaaaagatgaatactcagtttacagccgtgggcaaagagttcaataaactcgagagacgtatggaaaacctcaataagaaggtggatgacggcttcctggacatttggacttacaacgccgagctgctggtcctgctcgagaacgagagaacccttgacttccacgacagcaacgtcaagaacctgtacgagaaggtgaaaagtcaacttaaaaacaatgccaaggagattggtaacggctgcttcgaattctaccacaagtgtaataatgagtgcatggaatccgttaagaacggcacctacgattaccctaaatactcagaggagtccaagcttaaccgcgagaagatcgacggcgtaaaactggaaagcatgggcgtataccaacaccatcatcaccatcactaataggcatgc

SEQ ID NO: 143 - DNA, 909 bp, Artificial Sequence
  HA1-1 VN
atgaaattcttagtcaacgttgcccttgtttttatggtcgtatacatttcttacatctatgcggagaagaaacacaacggtaagctttgcgacttggatggagtcaagcccctcatacttagagattgtagtgtagccggttggctgctcggtaacccaatgtgcgatgagttcatcaatgttcccgaatggtcatatatcgtcgaaaaagctaatcctgtcaacgacctgtgctaccccggtgatttcaatgactatgaagaactgaagcacctgctctcccgcatcaaccatttcgagaaaatccagatcattcccaagagttcctggtctagccatgaggctagtctgggtgtctcatccgcctgcccatatcagggtaaaagttctttctttaggaacgtagtatggttgataaagaaaaactctacatacccgaccatcaagcgctcttacaacaatacgaaccaagaggatctgcttgtcctttggggaatccatcatcctaatgatgctgccgaacagactaagctctaccaaaaccctaccacttatatttccgtcggcacctctactctgaaccagcgccttgtgcccaggatcgctacgagatcaaaagtcaacggccaatcgggccgcatggaattcttctggacgatcctgaagcctaatgacgctatcaacttcgagtcaaatggaaactttatcgctcccgagtacgcttacaagatcgtcaagaagggcgactccacgattatgaagtcagagttggagtacggcaactgcaacacaaagtgccaaactcctatgggcgctataaattcttcaatgccgttccacaacatccatccgctcacgatcggtgagtgcccgaaatatgtaaagcaccatcaccaccatcactaatag

SEQ ID NO: 144 - DNA, 99 bp, Artificial Sequence
  FOR PRIMER
aggcagatctatgaaattcttagtcaacgttgcccttgtttttatggtcgtatacatttcttacatctatgcggagaagaaacacaacggtaagctttg

SEQ ID NO: 145 - DNA, 58 bp, Artificial Sequence
  REV PRIMER
agtcgcatgcctattatggtggtgatgatggtgctttacatatttcgggcactcaccg

SEQ ID NO: 146 - DNA, 1644 bp, Artificial Sequence
  HA0s VN
agatctatgaaattcttggttaatgtagccctggtgtttatggtagtgtacatttcatacatttatgctgatcaaatctgcattggctaccatgccaacaacagcaccgagcaagttgacacgatcatggagaagaacgtaaccgtcactcacgctcaagacatcctggagaagaaacacaacggtaagctttgcgacttggatggagtcaagcccctcatacttagagattgtagtgtagccggttggctgctcggtaacccaatgtgcgatgagttcatcaatgttcccgaatggtcatatatcgtcgaaaaagctaatcctgtcaacgacctgtgctaccccggtgatttcaatgactatgaagaactgaagcacctgctctcccgcatcaaccatttcgagaaaatccagatcattcccaagagttcctggtctagccatgaggctagtctgggtgtctcatccgcctgcccatatcagggtaaaagttctttctttaggaacgtagtatggttgataaagaaaaactctacatacccgaccatcaagcgctcttacaacaatacgaaccaagaggatctgcttgtcctttggggaatccatcatcctaatgatgctgccgaacagactaagctctaccaaaaccctaccacttatatttccgtcggcacctctactctgaaccagcgccttgtgcccaggatcgctacgagatcaaaagtcaacggccaatcgggccgcatggaattcttctggacgatcctgaagcctaatgacgctatcaacttcgagtcaaatggaaactttatcgctcccgagtacgcttacaagatcgtcaagaagggcgactccacgattatgaagtcagagttggagtacggcaactgcaacacaaagtgccaaactcctatgggcgctataaattcttcaatgccgttccacaacatccatccgctcacgatcggtgagtgcccgaaatatgtaaagtcgaatcgtctcgtactggcgacaggcctgagaaatagtccgcaacgtgaacgtcgtcgcaagaagagaggactgtttggtgccattgcaggctttattgagggcggctggcagggcatggttgacggatggtacggctaccaccattcaaacgagcagggatctggctacgccgctgacaaagaaagcacccaaaaggccattgatggagtgacgaataaggtgaattcgatcatcgacaaaatgaacacgcaattcgaagcagtgggtcgcgaattcaataacctggagcgccgtatcgagaatctgaacaagaagatggaagacggctttttggatgtctggacatataacgctgaattgctggtcctcatggaaaacgagcgtacccttgatttccacgacagcaacgttaagaacctctacgacaaggtcaggctccagctcagggataacgccaaggaattgggaaacggatgcttcgagttctaccacaaatgcgacaacgagtgcatggagtcagtcaggaatggtacctacgactacccgcaatattctgaggaggctcgcttgaagcgtgaggaaatatcgggtgttaaattggagagtattggaatctaccagcaccatcaccaccatcactaataggcatgc

SEQ ID NO: 147 - DNA, 909 bp, Artificial Sequence
  HA1-1 IND
atgaaattcttagtcaacgttgcccttgtttttatggtcgtatacatttcttacatctatgcggagaaaacccataacggtaagttgtgcgaccttgacggtgtaaagcccctgatcctccgtgactgcagtgttgctggttggcttttgggcaaccccatgtgtgacgaatttatcaacgtgcctgaatggtcatacattgtagagaaggccaaccccacgaacgatctctgttatcccggcagcttcaatgactatgaggaacttaagcaccttctgtcacgtatcaaccacttcgaaaagatccagatcatcccgaagagctcctggagcgaccacgaagccagttcgggtgtgtcttccgcttgcccctacctcggtagcccttccttcttccgtaacgtagtgtggctgatcaagaagaatagcacttaccctacaatcaaaaagtcgtataacaatactaaccaagaggatctgcttgtactctggggaattcatcatcccaacgacgcggcggagcagaccaggttgtaccagaaccccaccacttacatctccatcggtacgtccacactgaatcagcgtctggtccccaagatcgcaaccaggtccaaggttaacggtcagtccggtcgtatggagttcttctggaccatcctgaagcccaacgacgccatcaacttcgagtccaacggtaatttcattgctccggagtacgcctacaagatagttaagaagggtgattcagcgatcatgaagtcggaacttgagtatggcaactgcaacactaaatgccaaactccaatgggcgctatcaactccagtatgccattccataacatccacccattgacaatcggtgaatgtcccaagtacgtgaagcaccaccatcaccatcactaatag

SEQ ID NO: 148 - DNA, 99 bp, Artificial Sequence
  FOR PRIMER
aggcagatctatgaaattcttagtcaacgttgcccttgtttttatggtcgtatacatttcttacatctatgcggagaaaacccataacggtaagttgtg

SEQ ID NO: 149 - DNA, 63 bp, Artificial Sequence
  REV PRIMER
agtcgcatgcctattaatggtggtgatgatggtgcttcacgtacttgggacattcaccgattg

SEQ ID NO: 150 - DNA, 1644 bp, Artificial Sequence
  HA0s IND
agatctatgaagttcctggtcaatgtagccttggtatttatggtagtctatatctcgtacatttacgcagaccagatttgtattggatatcacgctaacaacagcacagagcaggtagatactattatggagaaaaatgttaccgtcactcacgcccaggacatcctggagaaaacccataacggtaagttgtgcgaccttgacggtgtaaagcccctgatcctccgtgactgcagtgttgctggttggcttttgggcaaccccatgtgtgacgaatttatcaacgtgcctgaatggtcatacattgtagagaaggccaaccccacgaacgatctctgttatcccggcagcttcaatgactatgaggaacttaagcaccttctgtcacgtatcaaccacttcgaaaagatccagatcatcccgaagagctcctggagcgaccacgaagccagttcgggtgtgtcttccgcttgcccctacctcggtagcccttccttcttccgtaacgtagtgtggctgatcaagaagaatagcacttaccctacaatcaaaaagtcgtataacaatactaaccaagaggatctgcttgtactctggggaattcatcatcccaacgacgcggcggagcagaccaggttgtaccagaaccccaccacttacatctccatcggtacgtccacactgaatcagcgtctggtccccaagatcgcaaccaggtccaaggttaacggtcagtccggtcgtatggagttcttctggaccatcctgaagcccaacgacgccatcaacttcgagtccaacggtaatttcattgctccggagtacgcctacaagatagttaagaagggtgattcagcgatcatgaagtcggaacttgagtatggcaactgcaacactaaatgccaaactccaatgggcgctatcaactccagtatgccattccataacatccacccattgacaatcggtgaatgtcccaagtacgtgaagagcaacaggttggtattggccaccggtttgagaaacagcccccagagagagtcgcgtcgtaaaaagcgcggcttgttcggagccatcgctggcttcatagagggtggttggcagggaatggtcgatggttggtatggttatcatcattccaacgagcagggaagtggttacgccgccgacaaagaatcgacccagaaggctattgacggcgtcacaaacaaagtaaactctatcattgataagatgaacacccagttcgaggctgtaggtagagaattcaacaacctcgaaagacgtattgagaacctgaacaagaaaatggaggatggcttcctggacgtgtggacctacaatgctgagctgttggtccttatggagaacgagcgtaccctcgatttccatgactcaaacgtgaagaacctgtatgacaaggtgcgtttgcaactgagggacaacgcaaaggagcttggaaacggttgtttcgaattttatcataagtgcgacaatgagtgtatggagtcgattagaaatggcacgtacaactaccctcaatacagcgaagaagctcgtctcaaacgtgaggaaatcagcggcgtcaagctcgaatcaatcggtacctatcagcaccaccatcaccatcactaataggcatgc

SEQ ID NO: 151 - protein, 811 aa, Artificial Sequence
  STF2.HA1-1His (PR8)
MKFLVNVALVFMVVYISYIYAAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASGSGSGSSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRHHHHHH

SEQ ID NO: 152 - protein, 811 aa, Artificial Sequence
  ngSTF2.HA1-1His (PR8)
MKFLVNVALVFMVVYISYIYAAQVINTNSLSLLTQNNLQKSQSALGTAIERLSSGLRINSAKDDAAGQAIANRFTANIKGLTQASRNANDGISIAQTTEGALNEINNNLQRVRELAVQSAQSTNSQSDLDSIQAEITQRLNEIDRVSGQTQFNGVKVLAQDNTLTIQVGANDGETIDIDLKQINSQTLGLDSLNVQKAYDVKDTAVTTKAYANQGTTLDVSGLDDAAIKAATGGTQGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYQASKAAGHDFKAQPELAEAAAKTTENPLQKIDAALAQVDALRSDLGAVQNRFNSAITNLGNTVNQLSEARSRIEDSDYATEVSQMSRAQILQQAGTSVLAQANQVPQNVLSLLASGSGSGSSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSQASMHECNTKCQTPLGAIQSSLPYQNIHPVTIGECPKYVRHHHHHH

SEQ ID NO: 153 - protein, 761 aa, Artificial Sequence
  STF2.HA1-2His (PR8)
MKFLVNVALVFMVVYISYIYAAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASGSGSGSKGIAPQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSHHHHHH

SEQ ID NO: 154 - protein, 762 aa, Artificial Sequence
  ngSTF2.HA1-2His (PR8)
MKFLVNVALVFMVVYISYIYAAQVINTNSLSLLTQNNLQKSQSALGTAIERLSSGLRINSAKDDAAGQAIANRFTANIKGLTQASRNANDGISIAQTTEGALNEINNNLQRVRELAVQSAQSTNSQSDLDSIQAEITQRLNEIDRVSGQTQFNGVKVLAQDNTLTIQVGANDGETIDIDLKQINSQTLGLDSLNVQKAYDVKDTAVTTKAYANQGTTLDVSGLDDAAIKAATGGTQGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYQASKAAGHDFKAQPELAEAAAKTTENPLQKIDAALAQVDALRSDLGAVQNRFNSAITNLGNTVNQLSEARSRIEDSDYATEVSQMSRAQILQQAGTSVLAQANQVPQNVLSLLASGSGSGSKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSHHHHHH

SEQ ID NO: 155 - protein, 762 aa, Artificial Sequence
  STF2.HA1-2mutHis (PR8)
MKFLVNVALVFMVVYISYIYAAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASGSGSGSKGAAPLQLGKCNIAGWLLGNPECDPLLPVRSWSDIAETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSHHHHHH

SEQ ID NO: 156 - protein, 761 aa, Artificial Sequence
  ngSTF2.HA1-2mutHis (PR8)
MKFLVNVALVFMVVYISYIYAAQVINTNSLSLLTQNNLQKSQSALGTAIERLSSGLRINSAKDDAAGQAIANRFTANIKGLTQASRNANDGISIAQTTEGALNEINNNLQRVRELAVQSAQSTNSQSDLDSIQAEITQRLNEIDRVSGQTQFNGVKVLAQDNTLTIQVGANDGETIDIDLKQINSQTLGLDSLNVQKAYDVKDTAVTTKAYANQGTTLDVSGLDDAAIKAATGGTQGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYQASKAAGHDFKAQPELAEAAAKTTENPLQKIDAALAQVDALRSDLGAVQNRFNSAITNLGNTVNQLSEARSRIEDSDYATEVSQMSRAQILQQAGTSVLAQANQVPQNVLSLLASGSGSGSKGAAPQLGKCNIAGWLLGNPECDPLLPVRSWSDIAETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSHHHHHH

SEQ ID NO: 157 - protein, 714 aa, Artificial Sequence
  STF2.HA1-3His (PR8)
MKFLVNVALVFMVVYISYIYAAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASGSGSGSNSENGCYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGHHHHHH

SEQ ID NO: 158 - protein, 715 aa, Artificial Sequence
  STF2.HA1-3mutHis (PR8)
MKFLVNVALVFMVVYISYIYAAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASGSGSGSNSENEICYPGDFIDKEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAAALSRGHHHHHH

SEQ ID NO: 159 - protein, 729 aa, Artificial Sequence
  STF2.HA1-2 (IND)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSE

SEQ ID NO: 160 - DNA, 2433 bp, Artificial Sequence
  STF2delta.HA0shis
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcgacacaatatgtataggctaccatgcgaacaattcaaccgacactgttgacacagtactcgagaagaatgtgacagtgacacactctgttaacctgctcgaagacagccacaacggaaaactatgtagattaaaaggaatagccccactacaattggggaaatgtaacatcgccggatggcttttgggaaacccagaatgcgacccactgcttccagtgagatcatggtcctacattgtagaaacaccaaactctgagaatggaatatgttatccaggagatttcatcgactatgaggagctgagggagcaattgagctcagtgtcatcattcgaaagattcgaaatatttcccaaagaaagctcatggcccaaccacaacacaaacggagtaacggcagcatgctcccatgaggggaaaagcagtttttacagaaatttgctatggctgacggagaaggagggctcatacccaaagctgaaaaattcttatgtgaacaaaaaagggaaagaagtccttgtactgtggggtattcatcacccgcctaacagtaaggaacaacagaatctctatcagaatgaaaatgcttatgtctctgtagtgacttcaaattataacaggagatttaccccggaaatagcagaaagacccaaagtaagagatcaagctgggaggatgaactattactggaccttgctaaaacccggagacacaataatatttgaggcaaatggaaatctaatagcaccaatgtatgctttcgcactgagtagaggctttgggtccggcatcatcacctcaaacgcatcaatgcatgagtgtaacacgaagtgtcaaacacccctgggagctataaacagcagtctcccttaccagaatatacacccagtcacaataggagagtgcccaaaatacgtcaggagtgccaaattgaggatggttacaggactaaggaacattccgtccattcaatccagaggtctatttggagccattgccggttttattgaagggggatggactggaatgatagatggatggtatggttatcatcatcagaatgaacagggatcaggctatgcagcggatcaaaaaagcacacaaaatgccattaacgggattacaaacaaggtgaacactgttatcgagaaaatgaacattcaattcacagctgtgggtaaagaattcaacaaattagaaaaaaggatggaaaatttaaataaaaaagttgatgatggatttctggacatttggacatataatgcagaattgttagttctactggaaaatgaaaggactctggatttccatgactcaaatgtgaagaatctgtatgagaaagtaaaaagccaattaaagaataatgccaaagaaatcggaaatggatgttttgagttctaccacaagtgtgacaatgaatgcatggaaagtgtaagaaatgggacttatgattatcccaaatattcagaagagtcaaagttgaacagggaaaaggtagatggagtgaaattggaatcaatggggatctatcagacgcgtaccggtcatcatcaccatcaccattga

SEQ ID NO: 161 - DNA, 40 bp, Artificial Sequence
  FOR PRIMER
attctccggcggccgctcgacacaatatgtataggctacc

SEQ ID NO: 162 - DNA, 60 bp, Artificial Sequence
  REV PRIMER
agtcttgcggccgcctattaatggtgatggtgatgatgctgatagatccccattgattcc

SEQ ID NO: 163 - DNA, 1533 bp, Artificial Sequence
  HA0s PR8 template
gacacaatatgtataggctaccatgcgaacaattcaaccgacactgttgacacagtactcgagaagaatgtgacagtgacacactctgttaacctgctcgaagacagccacaacggaaaactatgtagattaaaaggaatagccccactacaattggggaaatgtaacatcgccggatggcttttgggaaacccagaatgcgacccactgcttccagtgagatcatggtcctacattgtagaaacaccaaactctgagaatggaatatgttatccaggagatttcatcgactatgaggagctgagggagcaattgagctcagtgtcatcattcgaaagattcgaaatatttcccaaagaaagctcatggcccaaccacaacacaaacggagtaacggcagcatgctcccatgaggggaaaagcagtttttacagaaatttgctatggctgacggagaaggagggctcatacccaaagctgaaaaattcttatgtgaacaaaaaagggaaagaagtccttgtactgtggggtattcatcacccgcctaacagtaaggaacaacagaatctctatcagaatgaaaatgcttatgtctctgtagtgacttcaaattataacaggagatttaccccggaaatagcagaaagacccaaagtaagagatcaagctgggaggatgaactattactggaccttgctaaaacccggagacacaataatatttgaggcaaatggaaatctaatagcaccaatgtatgctttcgcactgagtagaggctttgggtccggcatcatcacctcaaacgcatcaatgcatgagtgtaacacgaagtgtcaaacacccctgggagctataaacagcagtctcccttaccagaatatacacccagtcacaataggagagtgcccaaaatacgtcaggagtgccaaattgaggatggttacaggactaaggaacattccgtccattcaatccagaggtctatttggagccattgccggttttattgaagggggatggactggaatgatagatggatggtatggttatcatcatcagaatgaacagggatcaggctatgcagcggatcaaaaaagcacacaaaatgccattaacgggattacaaacaaggtgaacactgttatcgagaaaatgaacattcaattcacagctgtgggtaaagaattcaacaaattagaaaaaaggatggaaaatttaaataaaaaagttgatgatggatttctggacatttggacatataatgcagaattgttagttctactggaaaatgaaaggactctggatttccatgactcaaatgtgaagaatctgtatgagaaagtaaaaagccaattaaagaataatgccaaagaaatcggaaatggatgttttgagttctaccacaagtgtgacaatgaatgcatggaaagtgtaagaaatgggacttatgattatcccaaatattcagaagagtcaaagttgaacagggaaaaggtagatggagtgaaattggaatcaatggggatctatcag

SEQ ID NO: 164 - DNA, 2403 bp, Artificial Sequence
  STF2delta.HA0s
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcgacacaatatgtataggctaccatgcgaacaattcaaccgacactgttgacacagtactcgagaagaatgtgacagtgacacactctgttaacctgctcgaagacagccacaacggaaaactatgtagattaaaaggaatagccccactacaattggggaaatgtaacatcgccggatggcttttgggaaacccagaatgcgacccactgcttccagtgagatcatggtcctacattgtagaaacaccaaactctgagaatggaatatgttatccaggagatttcatcgactatgaggagctgagggagcaattgagctcagtgtcatcattcgaaagattcgaaatatttcccaaagaaagctcatggcccaaccacaacacaaacggagtaacggcagcatgctcccatgaggggaaaagcagtttttacagaaatttgctatggctgacggagaaggagggctcatacccaaagctgaaaaattcttatgtgaacaaaaaagggaaagaagtccttgtactgtggggtattcatcacccgcctaacagtaaggaacaacagaatctctatcagaatgaaaatgcttatgtctctgtagtgacttcaaattataacaggagatttaccccggaaatagcagaaagacccaaagtaagagatcaagctgggaggatgaactattactggaccttgctaaaacccggagacacaataatatttgaggcaaatggaaatctaatagcaccaatgtatgctttcgcactgagtagaggctttgggtccggcatcatcacctcaaacgcatcaatgcatgagtgtaacacgaagtgtcaaacacccctgggagctataaacagcagtctcccttaccagaatatacacccagtcacaataggagagtgcccaaaatacgtcaggagtgccaaattgaggatggttacaggactaaggaacattccgtccattcaatccagaggtctatttggagccattgccggttttattgaagggggatggactggaatgatagatggatggtatggttatcatcatcagaatgaacagggatcaggctatgcagcggatcaaaaaagcacacaaaatgccattaacgggattacaaacaaggtgaacactgttatcgagaaaatgaacattcaattcacagctgtgggtaaagaattcaacaaattagaaaaaaggatggaaaatttaaataaaaaagttgatgatggatttctggacatttggacatataatgcagaattgttagttctactggaaaatgaaaggactctggatttccatgactcaaatgtgaagaatctgtatgagaaagtaaaaagccaattaaagaataatgccaaagaaatcggaaatggatgttttgagttctaccacaagtgtgacaatgaatgcatggaaagtgtaagaaatgggacttatgattatcccaaatattcagaagagtcaaagttgaacagggaaaaggtagatggagtgaaattggaatcaatggggatctatcagtag

SEQ ID NO: 165 - DNA, 40 bp, Artificial Sequence; identical to SEQ ID NO: 161
  FOR PRIMER

SEQ ID NO: 166 - DNA, 60 bp, Artificial Sequence; identical to SEQ ID NO: 162
  REV PRIMER

SEQ ID NO: 167 - DNA, 2403 bp, Artificial Sequence
  HA0s.STF2delta
gacacaatatgtataggctaccatgcgaacaattcaaccgacactgttgacacagtactcgagaagaatgtgacagtgacacactctgttaacctgctcgaagacagccacaacggaaaactatgtagattaaaaggaatagccccactacaattggggaaatgtaacatcgccggatggcttttgggaaacccagaatgcgacccactgcttccagtgagatcatggtcctacattgtagaaacaccaaactctgagaatggaatatgttatccaggagatttcatcgactatgaggagctgagggagcaattgagctcagtgtcatcattcgaaagattcgaaatatttcccaaagaaagctcatggcccaaccacaacacaaacggagtaacggcagcatgctcccatgaggggaaaagcagtttttacagaaatttgctatggctgacggagaaggagggctcatacccaaagctgaaaaattcttatgtgaacaaaaaagggaaagaagtccttgtactgtggggtattcatcacccgcctaacagtaaggaacaacagaatctctatcagaatgaaaatgcttatgtctctgtagtgacttcaaattataacaggagatttaccccggaaatagcagaaagacccaaagtaagagatcaagctgggaggatgaactattactggaccttgctaaaacccggagacacaataatatttgaggcaaatggaaatctaatagcaccaatgtatgctttcgcactgagtagaggctttgggtccggcatcatcacctcaaacgcatcaatgcatgagtgtaacacgaagtgtcaaacacccctgggagctataaacagcagtctcccttaccagaatatacacccagtcacaataggagagtgcccaaaatacgtcaggagtgccaagttgaggatggttacaggactaaggaacattccgtccattcaatccagaggtctatttggagccattgccggttttattgaagggggatggactggaatgatagatggatggtatggttatcatcatcagaatgaacagggatcaggctatgcagcggatcaaaaaagcacacaaaatgccattaacgggattacaaacaaggtgaacactgttatcgagaaaatgaacattcaattcacagctgtgggtaaagaattcaacaaattagaaaaaaggatggaaaatttaaataaaaaagttgatgatggatttctggacatttggacatataatgcagaattgttagttctactggaaaatgaaaggactctggatttccatgactcaaatgtgaagaatctgtatgagaaagtaaaaagccaattaaagaataatgccaaagaaatcggaaatggatgttttgagttctaccacaagtgtgacaatgaatgcatggaaagtgtaagaaatgggacttatgattatcccaaatattcagaagagtcaaagttgaacagggaaaaggtagatggagtgaaattggaatcaatggggatctatcaggaattctctagatatccagcacagtggcggccgctcgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgttaatag

SEQ ID NO: 168 - DNA, 33 bp, Artificial Sequence
  FOR PRIMER
aggcaagatctgacacaatatgtataggctacc

SEQ ID NO: 169 - DNA, 36 bp, Artificial Sequence
  REV PRIMER
agtcagacgcgtctattaacgtaacagagacagcac

SEQ ID NO: 170 - DNA, 1566 bp, Artificial Sequence
  Ha0s.his
gacacaatatgtataggctaccatgcgaacaattcaaccgacactgttgacacagtactcgagaagaatgtgacagtgacacactctgttaacctgctcgaagacagccacaacggaaaactatgtagattaaaaggaatagccccactacaattggggaaatgtaacatcgccggatggcttttgggaaacccagaatgcgacccactgcttccagtgagatcatggtcctacattgtagaaacaccaaactctgagaatggaatatgttatccaggagatttcatcgactatgaggagctgagggagcaattgagctcagtgtcatcattcgaaagattcgaaatatttcccaaagaaagctcatggcccaaccacaacacaaacggagtaacggcagcatgctcccatgaggggaaaagcagtttttacagaaatttgctatggctgacggagaaggagggctcatacccaaagctgaaaaattcttatgtgaacaaaaaagggaaagaagtccttgtactgtggggtattcatcacccgcctaacagtaaggaacaacagaatctctatcagaatgaaaatgcttatgtctctgtagtgacttcaaattataacaggagatttaccccggaaatagcagaaagacccaaagtaagagatcaagctgggaggatgaactattactggaccttgctaaaacccggagacacaataatatttgaggcaaatggaaatctaatagcaccaatgtatgctttcgcactgagtagaggctttgggtccggcatcatcacctcaaacgcatcaatgcatgagtgtaacacgaagtgtcaaacacccctgggagctataaacagcagtctcccttaccagaatatacacccagtcacaataggagagtgcccaaaatacgtcaggagtgccaaattgaggatggttacaggactaaggaacattccgtccattcaatccagaggtctatttggagccattgccggttttattgaagggggatggactggaatgatagatggatggtatggttatcatcatcagaatgaacagggatcaggctatgcagcggatcaaaaaagcacacaaaatgccattaacgggattacaaacaaggtgaacactgttatcgagaaaatgaacattcaattcacagctgtgggtaaagaattcaacaaattagaaaaaaggatggaaaatttaaataaaaaagttgatgatggatttctggacatttggacatataatgcagaattgttagttctactggaaaatgaaaggactctggatttccatgactcaaatgtgaagaatctgtatgagaaagtaaaaagccaattaaagaataatgccaaagaaatcggaaatggatgttttgagttctaccacaagtgtgacaatgaatgcatggaaagtgtaagaaatgggacttatgattatcccaaatattcagaagagtcaaagttgaacagggaaaaggtagatggagtgaaattggaatcaatggggatctatcagacgcgtaccggtcatcatcaccatcaccattga

SEQ ID NO: 171 - DNA, 40 bp, Artificial Sequence; identical to SEQ ID NO: 161
  FOR PRIMER

SEQ ID NO: 172 - DNA, 60 bp, Artificial Sequence; identical to SEQ ID NO: 162
  HA0s

SEQ ID NO: 173 - DNA, 1533 bp, Artificial Sequence; identical to SEQ ID NO: 163
  HA0s

SEQ ID NO: 174 - DNA, 33 bp, Artificial Sequence; identical to SEQ ID NO: 168
  FOR PRIMER

SEQ ID NO: 175 - DNA, 36 bp, Artificial Sequence; identical to SEQ ID NO: 169
  REV PRIMER

SEQ ID NO: 176 - protein, 517 aa, Artificial Sequence
  HA0sHis (PR8)
DTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQHHHHHH

SEQ ID NO: 177 - protein, 800 aa, Artificial Sequence
  STF2delta.HA0s (PR8)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLDTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQ

SEQ ID NO: 178 - DNA, 1518 bp, Artificial Sequence
  STF2
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgt

SEQ ID NO: 179 - protein, 299 aa, Artificial Sequence
  HA1-1his (PR8)
MKFLVNVALVFMVVYISYIYASHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRHHHHHH

SEQ ID NO: 180 - protein, 301 aa, Artificial Sequence
  HA1-1his (VN)
MKFLVNVALVFMVVYISYIYAEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKHHHHHH

SEQ ID NO: 181 - protein, 301 aa, Artificial Sequence
  HA1-1his (IND)
MKFLVNVALVFMVVYISYIYAEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKHHHHHH

SEQ ID NO: 182 - protein, 299 aa, Artificial Sequence
  HA1-1his (NC)
MKFLVNVALVFMVVYISYIYASHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRHHHHHH

SEQ ID NO: 183 - DNA, 888 bp, Artificial Sequence
  HA1-1 (MAL)
accactaccccaaccaaatctcacttcgcaaacctgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttccctgccgctgatcggtgaagcagactgcctgcacgagaaatacggcggtctgaacaaaagcaagccgtactataccggcgaacatgcgaaagcaattggtaactgtccaatttgggtgaaatagtag

SEQ ID NO: 184 - DNA, 2406 bp, Artificial Sequence
  STF2.HA1-1 (MAL)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaccactaccccaaccaaatctcacttcgcaaacctgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttccctgccgctgatcggtgaagcagactgcctgcacgagaaatacggcggtctgaacaaaagcaagccgtactataccggcgaacatgcgaaagcaattggtaactgtccaatttgggtgaaatagtag

SEQ ID NO: 185 - DNA, 729 bp, Artificial Sequence
  HA1-2 (MAL)
aaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 186 - DNA, 2247 bp, Artificial Sequence
  STF2.HA1-2 (MAL)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactgaaacccgtggcaagctgtgtccgaagtgtctgaactgcaccgatctggacgtcgcactgggtcgtccgaaatgtactggtaacattccgtccgcgcgtgtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaacgcgccgggcggtagctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacggtttggggcttccactccgacaacgaggcacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 187 - DNA, 725 bp, Artificial Sequence
  HA1-2 (SH)
aaaggcactcgtacccgcggtaagctgtgcccggactgcctgaactgtaccgatctggatgttgcactgggtcgtccgatgtgcgttggtaccaccccgtctgcgaaagccagcatcctgcacgaagttcgcccggttacttccggttgtttcccgattatgcatgatcgtaccaaaattcgtcagctgccaaacctgctgcgtggctatgaaaacattcgtctgtccactcaaaacgtaatcgatgcagaaaaagcgctgggtggcccgtatcgtctgggtaccagcggctcctgcccgaacgcgacgagcaaaagcggcttcttcgccaccatggcttgggccgttccgaaagacaacaacaaaaacgctacgaacccgctgaccgtcgaagtcccgtacatctgcaccgaaggcgaagatcagatcactgtgtggggcttccacagcgatgataagacccagatgaaaaatctgtacggtgactccaacccgcagaaattcacctcttctgctaacggtgtaacgacccactacgtttctcagatcggtggtttcccggaccagacggaagatggcggtctgcctcagtccggccgcatcgtagttgattacatggtccagaaaccgggtaagactggtaccattgtttaccagcgtggtgtactgctgccgcagaaggtctggtgtgcttccggccgttccaaggtcattaagggctgata

SEQ ID NO: 188 - DNA, 2244 bp, Artificial Sequence
  STF2.HA1-2 (SH)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactcgtacccgcggtaagctgtgcccggactgcctgaactgtaccgatctggatgttgcactgggtcgtccgatgtgcgttggtaccaccccgtctgcgaaagccagcatcctgcacgaagttcgcccggttacttccggttgtttcccgattatgcatgatcgtaccaaaattcgtcagctgccaaacctgctgcgtggctatgaaaacattcgtctgtccactcaaaacgtaatcgatgcagaaaaagcgctgggtggcccgtatcgtctgggtaccagcggctcctgcccgaacgcgacgagcaaaagcggcttcttcgccaccatggcttgggccgttccgaaagacaacaacaaaaacgctacgaacccgctgaccgtcgaagtcccgtacatctgcaccgaaggcgaagatcagatcactgtgtggggcttccacagcgatgataagacccagatgaaaaatctgtacggtgactccaacccgcagaaattcacctcttctgctaacggtgtaacgacccactacgtttctcagatcggtggtttcccggaccagacggaagatggcggtctgcctcagtccggccgcatcgtagttgattacatggtccagaaaccgggtaagactggtaccattgtttaccagcgtggtgtactgctgccgcagaaggtctggtgtgcttccggccgttccaaggtcattaagggctgatag

SEQ ID NO: 189 - DNA, 726 bp, Artificial Sequence
  HA1-2 (Lee)
aaaggcactcagacccgtggcaagctgtgtccgaactgtttcaactgcaccgatctggacgttgcactgggtcgtccgaaatgcatgggtaacatcccgtctgcgaaggtaagcatcctgcacgaagttaaaccggtaaccagcggctgtttcccgatcatgcacgacaaaactaaaattcgtcagctgccgaacctgctgcgtggttatgagaacattcgtctgtctacctctaatgttatcaacgcggagactgcaccaggtggcccatacaaagtaggtaccagcggttcctgtccgaacgttgcgaatcgtaacggcttcttcaacactatggcgtgggttatcccgaaagataacaataaaactgcaattaacccggtaactgtagaagttccgtacatctgctccgaaggcgaggaccagattacggtatggggctttcacagcgacgataaaacccagatggagcgtctgtacggtgactctaacccgcagaaattcacctcctccgcgaacggcgttaccacccactatgtttctcagatcggcggtttcccgaatcagaccgaagacgaaggcctgaagcagtccggccgtattgttgtagactacatggttcagaagccgggcaaaactggtaccattgtataccagcgcggcatcctgctgccgcagaaagtttggtgcgcttccggtcgtagcaaagtaatcaaaggttgatag

SEQ ID NO: 190 - DNA, 2244 bp, Artificial Sequence
  STF2.HA1-2 (Lee)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactcagacccgtggcaagctgtgtccgaactgtttcaactgcaccgatctggacgttgcactgggtcgtccgaaatgcatgggtaacatcccgtctgcgaaggtaagcatcctgcacgaagttaaaccggtaaccagcggctgtttcccgatcatgcacgacaaaactaaaattcgtcagctgccgaacctgctgcgtggttatgagaacattcgtctgtctacctctaatgttatcaacgcggagactgcaccaggtggcccatacaaagtaggtaccagcggttcctgtccgaacgttgcgaatcgtaacggcttcttcaacactatggcgtgggttatcccgaaagataacaataaaactgcaattaacccggtaactgtagaagttccgtacatctgctccgaaggcgaggaccagattacggtatggggctttcacagcgacgataaaacccagatggagcgtctgtacggtgactctaacccgcagaaattcacctcctccgcgaacggcgttaccacccactatgtttctcagatcggcggtttcccgaatcagaccgaagacgaaggcctgaagcagtccggccgtattgttgtagactacatggttcagaagccgggcaaaactggtaccattgtataccagcgcggcatcctgctgccgcagaaagtttggtgcgcttccggtcgtagcaaagtaatcaaaggttgatag

SEQ ID NO: 191 - DNA, 729 bp, Artificial Sequence
  HA1-2 (Ohio)
aaaggcactaaaacccgtggcaagctgtgtccgaagtgtctgaactgcaccgatctggacgtcgcactgggtcgtccgaaatgtactggtaacattccgtccgcggaagtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaaggcgccgggcggtccctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacgatttggggcttccactccgacagcgagacacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 192 - DNA, 2247 bp, Artificial Sequence
  STF2.HA1-2 (Ohio)
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgaaaggcactaaaacccgtggcaagctgtgtccgaagtgtctgaactgcaccgatctggacgtcgcactgggtcgtccgaaatgtactggtaacattccgtccgcggaagtctccatcctgcatgaagtgcgtccagtgacctccggctgttttccgattatgcatgatcgtactaaaatccgtcagctgccgaacctgctgcgtggttacgaacacattcgtctgtccacccataacgttatcaacgcggaaaaggcgccgggcggtccctataaaatcggtacctctggttcttgcccgaacgtgactaacggtaacggcttctttgcaaccatggcctgggcggtcccgaaaaacgacaacaacaagaccgcgaccaattccctgaccatcgaagtcccgtatatctgcaccgaaggtgaagatcaaatcacgatttggggcttccactccgacagcgagacacaaatggcgaaactgtacggtgacagcaaaccgcaaaaattcactagctccgctaacggtgttaccacccactacgtttcccagatcggtggtttcccaaaccagaccgaagatggtggtctgccgcagtccggtcgcatcgttgtagattatatggtgcagaaaagcggtaaaaccggtaccatcacctaccagcgtggcatcctgctgccgcagaaagtttggtgcgcttccggtcgtagcaaagtaatcaaaggttgatag

SEQ ID NO: 193 - DNA, 21 bp, Artificial Sequence
  FOR PRIMER
cggataacaattcccctctag

SEQ ID NO: 194 - DNA, 50 bp, Artificial Sequence
  REV PRIMER
cgaagtgagatttggttggagtagtggtcgctaacagagacagcacgttc

SEQ ID NO: 195 - DNA, 50 bp, Artificial Sequence
  FOR PRIMER
cccgcagaacgtgctgtctctgttagcgaccactaccccaaccaaatctc

SEQ ID NO: 196 - DNA, 20 bp, Artificial Sequence
  REV PRIMER
ctatttcacccaaattggac

SEQ ID NO: 197 - DNA, 51 bp, Artificial Sequence
  REV PRIMER
cacagcttgccacgggtttcagtgcctttcgctaacagagacagcacgttc

SEQ ID NO: 198 - DNA, 49 bp, Artificial Sequence
  FOR PRIMER
cccgcagaacgtgctgtctctgttagcgaaaggcactgaaacccgtggc

SEQ ID NO: 199 - DNA, 44 bp, Artificial Sequence
  REV PRIMER
gactagacgctcagctatcaacctttgattactttgctacgacc

SEQ ID NO: 200 - DNA, 51 bp, Artificial Sequence
  REV PRIMER
cacagcttaccgcgggtacgagtgcctttcgctaacagagacagcacgttc

SEQ ID NO: 201 - DNA, 32 bp, Artificial Sequence
  FOR PRIMER
cgggatccaaaggcactcgtacccgcggtaag

SEQ ID NO: 202 - DNA, 44 bp, Artificial Sequence
  REV PRIMER
gactagacgctcagctatcagcccttaatgaccttggaacggcc

SEQ ID NO: 203 - DNA, 52 bp, Artificial Sequence
  REV PRIMER
gcatagttttcctctggtctgtgttcctttcgctaacagagacagcacgttc

SEQ ID NO: 204 - DNA, 20 bp, Artificial Sequence
  FOR PRIMER
aaaggaacacagaccagagg

SEQ ID NO: 205 - DNA, 26 bp, Artificial Sequence
  REV PRIMER
ctactacccttttattaccttgctcc

SEQ ID NO: 206 - DNA, 51 bp, Artificial Sequence
  REV PRIMER
cacagcttgccacgggttttagtgcctttcgctaacagagacagcacgttc

SEQ ID NO: 207 - DNA, 21 bp, Artificial Sequence
  FOR PRIMER
aaaggcactaaaacccgtggc

SEQ ID NO: 208 - DNA, 44 bp, Artificial Sequence; identical to SEQ ID NO: 199
  REV PRIMER

SEQ ID NO: 209 - protein, 800 aa, Artificial Sequence
  STF2.HA1-1 (MAL)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLATTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 210 - protein, 747 aa, Artificial Sequence
  STF2.HA1-2 (MAL)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 211 - protein, 746 aa, Artificial Sequence
  STF2.HA1-2 (SH)
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKG

SEQ ID NO: 212 - protein, 1518 aa, Artificial Sequence
  STF2
ATGGCACAAGTAATCAACACTAACAGTCTGTCGCTGCTGACCCAGAATAACCTGAACAAATCCCAGTCCGCACTGGGCACCGCTATCGAGCGTCTGTCTTCTGGTCTGCGTATCAACAGCGCGAAAGACGATGCGGCAGGTCAGGCGATTGCTAACCGTTTCACCGCGAACATCAAAGGTCTGACTCAGGCTTCCCGTAACGCTAACGACGGTATCTCCATTGCGCAGACCACTGAAGGCGCGCTGAACGAAATCAACAACAACCTGCAGCGTGTGCGTGAACTGGCGGTTCAGTCTGCTAACAGCACCAACTCCCAGTCTGACCTCGACTCCATCCAGGCTGAAATCACCCAGCGCCTGAACGAAATCGACCGTGTATCCGGCCAGACTCAGTTCAACGGCGTGAAAGTCCTGGCGCAGGACAACACCCTGACCATCCAGGTTGGCGCCAACGACGGTGAAACTATCGATATCGATCTGAAGCAGATCAACTCTCAGACCCTGGGTCTGGACTCACTGAACGTGCAGAAAGCGTATGATGTGAAAGATACAGCAGTAACAACGAAAGCTTATGCCAATAATGGTACTACACTGGATGTATCGGGTCTTGATGATGCAGCTATTAAAGCGGCTACGGGTGGTACGAATGGTACGGCTTCTGTAACCGGTGGTGCGGTTAAATTTGACGCAGATAATAACAAGTACTTTGTTACTATTGGTGGCTTTACTGGTGCTGATGCCGCCAAAAATGGCGATTATGAAGTTAACGTTGCTACTGACGGTACAGTAACCCTTGCGGCTGGCGCAACTAAAACCACAATGCCTGCTGGTGCGACAACTAAAACAGAAGTACAGGAGTTAAAAGATACACCGGCAGTTGTTTCAGCAGATGCTAAAAATGCCTTAATTGCTGGCGGCGTTGACGCTACCGATGCTAATGGCGCTGAGTTGGTCAAAATGTCTTATACCGATAAAAATGGTAAGACAATTGAAGGCGGTTATGCGCTTAAAGCTGGCGATAAGTATTACGCCGCAGATTACGATGAAGCGACAGGAGCAATTAAAGCTAAAACTACAAGTTATACTGCTGCTGACGGCACTACCAAAACAGCGGCTAACCAACTGGGTGGCGTAGACGGTAAAACCGAAGTCGTTACTATCGACGGTAAAACCTACAATGCCAGCAAAGCCGCTGGTCATGATTTCAAAGCACAACCAGAGCTGGCGGAAGCAGCCGCTAAAACCACCGAAAACCCGCTGCAGAAAATTGATGCCGCGCTGGCGCAGGTGGATGCGCTGCGCTCTGATCTGGGTGCGGTACAAAACCGTTTCAACTCTGCTATCACCAACCTGGGCAATACCGTAAACAATCTGTCTGAAGCGCGTAGCCGTATCGAAGATTCCGACTACGCGACCGAAGTTTCCAACATGTCTCGCGCGCAGATTCTGCAGCAGGCCGGTACTTCCGTTCTGGCGCAGGCTAACCAGGTCCCGCAGAACGTGCTGTCTCTGTTACGT

SEQ ID NO: 213 - protein, 583 aa, Influenza B/Yamagata/16/18 HA
MKAIIVLLMVVTSNADRICTGITSSNSPHVVKTATQGEVNVTGVIPLTTTPTKSHFANLKGTKTRGKLCPNCLNCTDLDVALGRPMCMGTIPSAKASILHEVRPVTSGCFPIMHDRTKIRQLPNLLRGYENIRLSTHNVINAERAPGGPYRLGTSGSCPNVTSRNGFFATMAWAVPRDNKTATNPLTVEVPYICTKGEDQITVWGFHSDDKTQMKNLYGDSNPQKFTSSANGVTTHYVSQIGDFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 214 - protein, 6 aa, Artificial Sequence
  PR/8 HA Peptide
THSVNL

SEQ ID NO: 215 - protein, 6 aa, Artificial Sequence
  PR/8 HA Peptide
SHNGKL

SEQ ID NO: 216 - protein, 4 aa, Artificial Sequence
  PR/8 HA Peptide
CRLK

SEQ ID NO: 217 - protein, 4 aa, Artificial Sequence
  PR/8 HA Peptide
PYQN

SEQ ID NO: 218 - protein, 4 aa, Artificial Sequence
  PR/8 HA Peptide
PKYV

SEQ ID NO: 219 - protein, 4 aa, Artificial Sequence
  PR/8 HA Peptide
RSAK

SEQ ID NO: 220 - protein, 6 aa, Artificial Sequence
  PR/8 HA Peptide
NASMHE

SEQ ID NO: 221 - protein, 6 aa, Artificial Sequence
  PR/8 HA Peptide
APLQLG

SEQ ID NO: 222 - protein, 5 aa, Artificial Sequence
  PR/8 HA Peptide
GIITS

SEQ ID NO: 223 - protein, 4 aa, Artificial Sequence
  PR/8 HA Peptide
CNTK

SEQ ID NO: 224 - protein, 6 aa, Artificial Sequence
  PR/8 HA Peptide
SYIVET

SEQ ID NO: 225 - protein, 8 aa, Artificial Sequence
  PR/8 HA Peptide
NIAGWLLG

SEQ ID NO: 226 - protein, 5 aa, Artificial Sequence
  PR/8 HA Peptide
PGDFI

SEQ ID NO: 227 - protein, 8 aa, Artificial Sequence
  PR/8 HA Peptide
NSENGICY

SEQ ID NO: 228 - protein, 8 aa, Artificial Sequence
  PR/8 HA Peptide
AFALSRGF

SEQ ID NO: 229 - protein, 7 aa, Artificial Sequence
  PR/8 HA Peptide
AFALSRG

SEQ ID NO: 230 - protein, 6 aa, Artificial Sequence
  VN04 HA peptide
THAQDI

SEQ ID NO: 231 - protein, 6 aa, Artificial Sequence
  VN04 HA peptide
EKKHNG

SEQ ID NO: 232 - protein, 6 aa, Artificial Sequence
  VN04 HA peptide
KLCDLD

SEQ ID NO: 233 - protein, 4 aa, Artificial Sequence
  VN04 HA peptide
KSNR

SEQ ID NO: 234 - protein, 4 aa, Artificial Sequence
  VN04 HA peptide
PKYV

SEQ ID NO: 235 - protein, 6 aa, Artificial Sequence
  VN04 HA peptide
LVLATG

SEQ ID NO: 236 - protein, 5 aa, Artificial Sequence
  VN04 HA peptide
KPLIL

SEQ ID NO: 237 - protein, 5 aa, Artificial Sequence
  VN04 HA peptide
TIMKS

SEQ ID NO: 238 - protein, 5 aa, Artificial Sequence
  VN04 HA peptide
YGNCN

SEQ ID NO: 239 - protein, 6 aa, Artificial Sequence
  VN04 HA peptide
SYIVEK

SEQ ID NO: 240 - protein, 5 aa, Artificial Sequence
  VN04 HA peptide
PGDFN

SEQ ID NO: 241 - protein, 4 aa, Artificial Sequence
  VN04 HA peptide
KGDS

SEQ ID NO: 242 - protein, 8 aa, Artificial Sequence
  VN04 HA peptide
EYAYKIVK

SEQ ID NO: 243 - protein, 6 aa, Artificial Sequence
  IND05 HA peptide
THAQDI

SEQ ID NO: 244 - protein, 6 aa, Artificial Sequence
  IND05 HA peptide
EKTHNG

SEQ ID NO: 245 - protein, 6 aa, Artificial Sequence
  IND05 HA peptide
KLCDLD

SEQ ID NO: 246 - protein, 4 aa, Artificial Sequence
  IND05 HA peptide
KSNR

SEQ ID NO: 247 - protein, 4 aa, Artificial Sequence
  IND05 HA peptide
PKYV

SEQ ID NO: 248 - protein, 6 aa, Artificial Sequence
  IND05 HA peptide
LVLATG

SEQ ID NO: 249 - protein, 5 aa, Artificial Sequence
  IND05 HA peptide
KPLIL

SEQ ID NO: 250 - protein, 5 aa, Artificial Sequence
  IND05 HA peptide
AIMKS

SEQ ID NO: 251 - protein, 5 aa, Artificial Sequence
  IND05 HA peptide
YGNCN

SEQ ID NO: 252 - protein, 6 aa, Artificial Sequence
  IND05 HA peptide
SYIVEK

SEQ ID NO: 253 - protein, 5 aa, Artificial Sequence
  IND05 HA peptide
PGSFN

SEQ ID NO: 254 - protein, 8 aa, Artificial Sequence
  IND05 HA peptide
EYAYKIVK

SEQ ID NO: 255 - protein, 9 aa, Artificial Sequence
  New Caledonia HA peptide
THSVNLLED

SEQ ID NO: 256 - protein, 6 aa, Artificial Sequence
  New Caledonia HA peptide
SHNGKL

SEQ ID NO: 257 - protein, 6 aa, Artificial Sequence
  New Caledonia HA peptide
APLQLG

SEQ ID NO: 258 - protein, 4 aa, Artificial Sequence
  New Caledonia HA peptide
RSAK

SEQ ID NO: 259 - protein, 4 aa, Artificial Sequence
  New Caledonia HA peptide
PKYV

SEQ ID NO: 260 - protein, 6 aa, Artificial Sequence
  New Caledonia HA peptide
LRMVTG

SEQ ID NO: 261 - protein, 12 aa, Artificial Sequence
  New Caledonia HA peptide
SHNGKLCLLKGI

SEQ ID NO: 262 - protein, 6 aa, Artificial Sequence
  New Caledonia HA peptide
SGIITS

SEQ ID NO: 263 - protein, 9 aa, Artificial Sequence
  New Caledonia HA peptide
NAPMDECDA

SEQ ID NO: 264 - protein, 6 aa, Artificial Sequence
  New Caledonia HA peptide
SYIVET

SEQ ID NO: 265 - protein, 5 aa, Artificial Sequence
  New Caledonia HA peptide
PGYFA

SEQ ID NO: 266 - protein, 9 aa, Artificial Sequence
  New Caledonia HA peptide
YAFALSRGF

SEQ ID NO: 267 - protein, 5 aa, Artificial Sequence
  A/Wisconsin/67/2005 HA Peptide
TNATE

SEQ ID NO: 268 - protein, 5 aa, Artificial Sequence
  A/Wisconsin/67/2005 HA Peptide
PRYVK

SEQ ID NO: 269 - protein, 5 aa, Artificial Sequence
  A/Wisconsin/67/2005 HA Peptide
PFQNV

SEQ ID NO: 270 - protein, 6 aa, Artificial Sequence
  A/Wisconsin/67/2005 HA Peptide
QILDGE

SEQ ID NO: 271 - protein, 5 aa, Artificial Sequence
  A/Wisconsin/67/2005 HA Peptide
GGICD

SEQ ID NO: 272 - protein, 6 aa, Artificial Sequence
  A/Wisconsin/67/2005 HA Peptide
SSIMRS

SEQ ID NO: 273 - protein, 5 aa, Artificial Sequence
  A/Wisconsin/67/2005 HA Peptide
APIGK

SEQ ID NO: 274 - protein, 5 aa, Artificial Sequence
  A/Wisconsin/67/2005 HA Peptide
LFVER

SEQ ID NO: 275 - protein, 8 aa, Artificial Sequence
  A/Wisconsin/67/2005 HA Peptide
TLIDALLG

SEQ ID NO: 276 - protein, 6 aa, Artificial Sequence
  A/Wisconsin/67/2005 HA Peptide
RGYFKI

SEQ ID NO: 277 - protein, 8 aa, Artificial Sequence
  PR/8 HA1-3mut peptide
NSENEICY

SEQ ID NO: 278 - protein, 8 aa, Artificial Sequence
  PR/8 HA1-3mut peptide
KEELREQL

SEQ ID NO: 279 - protein, 6 aa, Artificial Sequence
  B/Lee/40 HA1-1 peptide
TTTPTK

SEQ ID NO: 280 - protein, 6 aa, Artificial Sequence
  B/Lee/40 HA1-1 peptide
CPIWVK

SEQ ID NO: 281 - protein, 6 aa, Artificial Sequence
  B/Lee/40 HA1-2 peptide
KGTQTR

SEQ ID NO: 282 - protein, 6 aa, Artificial Sequence
  B/Lee/40 HA1-2 peptide
SKVIKG

SEQ ID NO: 283 - protein, 6 aa, Artificial Sequence
  A/Aichi/2/68 HA1-1 peptide
QSSSTG

SEQ ID NO: 284 - protein, 6 aa, Artificial Sequence
  A/Aichi/2/68 HA1-1 peptide
CPKYVK

SEQ ID NO: 285 - protein, 6 aa, Artificial Sequence
  A/Aichi/2/68 HA1-2 peptide
HRILDG

SEQ ID NO: 286 - protein, 6 aa, Artificial Sequence
  A/Aichi/2/68 HA1-2 peptide
SIMRSD

SEQ ID NO: 287 - protein, 6 aa, Artificial Sequence
  B/Malaysia/2506/2004 HA1-1 peptide
TTTPTK

SEQ ID NO: 288 - protein, 6 aa, Artificial Sequence
  B/Malaysia/2506/2004 HA1-1 peptide
CPIWVK

SEQ ID NO: 289 - protein, 6 aa, Artificial Sequence
  B/Malaysia/2506/2004 HA1-2 peptide
KGTETR

SEQ ID NO: 290 - protein, 6 aa, Artificial Sequence
  B/Malaysia/2506/2004 HA1-2 peptide
SKVIKG

SEQ ID NO: 291 - protein, 6 aa, Artificial Sequence
  B/Ohio/1/2005 HA1-1 peptide
TTTPTK

SEQ ID NO: 292 - protein, 6 aa, Artificial Sequence
  B/Ohio/1/2005 HA1-1 peptide
CPIWVK

SEQ ID NO: 293 - protein, 6 aa, Artificial Sequence
  B/Ohio/1/2005 HA1-2 peptide
KGTKTR

SEQ ID NO: 294 - protein, 6 aa, Artificial Sequence
  B/Ohio/1/2005 HA1-2 peptide
SKVIKG

SEQ ID NO: 295 - protein, 6 aa, Artificial Sequence
  B/Shanghai/361/2002 HA1-1 peptide
TTTPIK

SEQ ID NO: 296 - protein, 6 aa, Artificial Sequence
  B/Shanghai/361/2002 HA1-1 peptide
CPIWVK

SEQ ID NO: 297 - protein, 6 aa, Artificial Sequence
  B/Shanghai/361/2002 HA1-2 peptide
KGTRTR

SEQ ID NO: 298 - protein, 6 aa, Artificial Sequence
  B/Shanghai/361/2002 HA1-2 peptide
SKVIKG

SEQ ID NO: 299 - protein, 4 aa, Artificial Sequence
  B/Lee/40 HA peptide
TGVI

SEQ ID NO: 300 - protein, 4 aa, Artificial Sequence
  B/Lee/40 HA peptide
TTTP

SEQ ID NO: 301 - protein, 4 aa, Artificial Sequence
  B/Lee/40 HA peptide
PIWV

SEQ ID NO: 302 - protein, 5 aa, Artificial Sequence
  B/Lee/40 HA peptide
PYYTG

SEQ ID NO: 303 - protein, 5 aa, Artificial Sequence
  B/Lee/40 HA peptide
DCLHE

SEQ ID NO: 304 - protein, 5 aa, Artificial Sequence
  B/Lee/40 HA peptide
YGGLN

SEQ ID NO: 305 - protein, 5 aa, Artificial Sequence
  B/Lee/40 HA peptide
KAIGN

SEQ ID NO: 306 - protein, 5 aa, Artificial Sequence
  B/Lee/40 HA peptide
TQTRG

SEQ ID NO: 307 - protein, 5 aa, Artificial Sequence
  B/Lee/40 HA peptide
KVIKG

SEQ ID NO: 308 - protein, 5 aa, Artificial Sequence
  B/Lee/40 HA peptide
DCLHE

SEQ ID NO: 309 - protein, 6 aa, Artificial Sequence
  B/Lee/40 HA peptide
SILHEV

SEQ ID NO: 310 - DNA, 18 bp, Artificial Sequence
  STF2
gtgctgagcctgttacgt

SEQ ID NO: 311 - protein, 7 aa, Artificial Sequence
  linker
SGSGSGS

SEQ ID NO: 312 - protein, 506 aa, S. typhimurium
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 313 - protein, 277 aa, Artificial Sequence
  STF2delta
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 314 - DNA, 831 bp, Artificial Sequence
  STF2delta
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgt

SEQ ID NO: 315 - DNA, 1518 bp, S. typhimurium; identical to SEQ ID NO: 178

SEQ ID NO: 316 - DNA, 2763 bp, Artificial Sequence
  STF2.OVA
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctcgagggctccatcggcgcagcaagcatggaattttgttttgatgtattcaaggagctcaaagtccaccatgccaatgagaacatcttctactgccccattgccatcatgtcagctctagccatggtatacctgggtgcaaaagacagcaccaggacacaaataaataaggttgttcgctttgataaacttccaggattcggagacagtattgaagctcagtgtggcacatctgtaaacgttcactcttcacttagagacatcctcaaccaaatcaccaaaccaaatgatgtttattcgttcagccttgccagtagactttatgctgaagagagatacccaatcctgccagaatacttgcagtgtgtgaaggaactgtatagaggaggcttggaacctatcaactttcaaacagctgcagatcaagccagagagctcatcaattcctgggtagaaagtcagacaaatggaattatcagaaatgtccttcagccaagctccgtggattctcaaactgcaatggttctggttaatgccattgtcttcaaaggactgtgggagaaagcatttaaggatgaagacacacaagcaatgcctttcagagtgactgagcaagaaagcaaacctgtgcagatgatgtaccagattggtttatttagagtggcatcaatggcttctgagaaaatgaagatcctggagcttccatttgccagtgggacaatgagcatgttggtgctgttgcctgatgaagtctcaggccttgagcagcttgagagtataatcaactttgaaaaactgactgaatggaccagttctaatgttatggaagagaggaagatcaaagtgtacttacctcgcatgaagatggaggaaaaatacaacctcacatctgtcttaatggctatgggcattactgacgtgtttagctcttcagccaatctgtctggcatctcctcagcagagagcctgaagatatctcaagctgtccatgcagcacatgcagaaatcaatgaagcaggcagagaggtggtagggtcagcagaggctggagtggatgctgcaagcgtctctgaagaatttagggctgaccatccattcctcttctgtatcaagcacatcgcaaccaacgccgttctcttctttggcagatgtgtttccccttcgaagcttgaaggtaagcctatccctaaccctctcctcggtctcgattctacgcgtaccggtcatcatcaccatcaccattga

SEQ ID NO: 317 - DNA, 38 bp, Artificial Sequence
  primer STF28BGF-1
ctcgggagatctgcacaagtaatcaacactaacagtct

SEQ ID NO: 318 - DNA, 41 bp, Artificial Sequence
  primer STF28MCR-1
ccatgggctagcaggatccaccggcgctccctgcacgttca

SEQ ID NO: 319 - DNA, 42 bp, Artificial Sequence
  primer STF28MCF-2
ggagcgccggtggatcctgctagcccatggaccgaaaacccg

SEQ ID NO: 320 - DNA, 84 bp, Artificial Sequence
  primer STF28ECR-2
tctgcagaattcacgtaacagagacagcacgttctgcgggacgtcccgcagaacgtgctgtctctgttacgtgaattctgcaga

SEQ ID NO: 321 - DNA, 37 bp, Artificial Sequence
  primer 3'Forward1
actgagtgcatatggcacaagtaatcaacactaacag

SEQ ID NO: 322 - DNA, 55 bp, Artificial Sequence
  primer 3'Reverse1
gactgactgctcagcctattagcagagcggccgccactgtgctggatatctagag

SEQ ID NO: 323 - DNA, 44 bp, Artificial Sequence
  primer 5'Forward2
agtcaggccatatgtgcgcacaagtaatcaacactaacagtctg

SEQ ID NO: 324 - DNA, 59 bp, Artificial Sequence
  primer 5"Reverse2
gactgactgctcagcctattaacgtaacagagacagcacgttctgcgggacctggttag

SEQ ID NO: 325 - DNA, 870 bp, Artificial Sequence
  STF2delta.3'Cys
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctctgc

SEQ ID NO: 326 - DNA, 834 bp, Artificial Sequence
  5'Cys.STF2delta
atgtgcgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgt

SEQ ID NO: 327 - DNA, 37 bp, Artificial Sequence; identical to SEQ ID NO: 321
  Primer HingeForward1

SEQ ID NO: 328 - DNA, 31 bp, Artificial Sequence
  Primer HingeReverse3
ggtccatgggcaagcaggatccaccggcgct

SEQ ID NO: 329 - DNA, 31 bp, Artificial Sequence
  Primer HingeForward2
agcgccggtggatcctgcttgcccatggacc

SEQ ID NO: 330 - DNA, 59 bp, Artificial Sequence; identical to SEQ ID NO: 324
  Primer HingeReverse4

SEQ ID NO: 331 - DNA, 831 bp, Artificial Sequence
  STF2delta.HingeCys
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgcttgcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgt

SEQ ID NO: 332 - protein, 290 aa, Artificial Sequence
  STF2delta.3'Cys
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLC

SEQ ID NO: 333 - protein, 277 aa, Artificial Sequence
  STF2delta.HingeCys
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPACPWTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 334 - protein, 278 aa, Artificial Sequence
  5'Cys.STF2delta
MCAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 335 - protein, 8 aa, Artificial Sequence
  lipopeptide
CSKKKKGC

SEQ ID NO: 336 - protein, 10 aa, Artificial Sequence
  linker
GAPVDPASPW

SEQ ID NO: 337 - protein, 19 aa, Artificial Sequence
  H1C1 peptide
NIPSIQSRGLFFAIAGFIE

SEQ ID NO: 338 - protein, 20 aa, Artificial Sequence
  Cys H1C1
CNIPSIQSRGLFFAIAGFIE

SEQ ID NO: 339 - protein, 20 aa, Artificial Sequence
  Lys H1C1
KNIPSIQSRGLFFAIAGFIE

SEQ ID NO: 340 - DNA, 1518 bp, Artificial Sequence; identical to SEQ ID NO: 51
  STF2.b1p

SEQ ID NO: 341 - protein, 19 aa, Artificial Sequence
  HA maturation cleavage fragment (H1N1)
NIPSIQSRGLFGAIAGFIE

SEQ ID NO: 342 - protein, 529 aa, Artificial Sequence
  STF2.1xH1C1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMEWENIPSIQSRGLFGAIAGFIE

SEQ ID NO: 343 - protein, 551 aa, Artificial Sequence
  STF2.2xH1C1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMEWENIPSIQSRGLFGAIAGFIEEWENIPSIQSRGLFGAIAGFIE

SEQ ID NO: 344 - protein, 573 aa, Artificial Sequence
  STF2.3xH1C1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMEWENIPSIQSRGLFGAIAGFIEEWENIPSIQSRGLFGAIAGFIEEWENIPSIQSRGLFGAIAGFIE

SEQ ID NO: 345 - protein, 595 aa, Artificial Sequence
  STF2.4xH1C1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAMEWENIPSIQSRGLFGAIAGFIEEWENIPSIQSRGLFGAIAGFIEEWENIPSIQSRGLFGAIAGFIEEWENIPSIQSRGLFGAIAGFIE

SEQ ID NO: 346 - protein, 601 aa, Artificial Sequence
  STF2.4xH1C2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGCGSEWENIPSIQSRGLFGAIAGFIEEWENIPSIQSRGLFGAIAGFIEEWENIPSIQSRGLFGAIAGFIEEWENIPSIQSRGLFGAIAGFIESGC

SEQ ID NO: 347 - protein, 19 aa, Artificial Sequence
  HA maturation cleavage fragment (H5N1)
RERRRKKRGLFGAIAGFIE

SEQ ID NO: 348 - protein, 594 aa, Artificial Sequence
  STF2.4xH5C1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAEWERERRRKKRGLFGAIAGFIEEWERERRRKKRGLFGAIAGFIEEWERERRRKKRGLFGAIAGFIEEWERERRRKKRGLFGAIAGFIE

SEQ ID NO: 349 - protein, 19 aa, Artificial Sequence
  HA maturation cleavage fragment (H3N2)
NVPEKQTRGIFGAIAGFIE

SEQ ID NO: 350 - protein, 19 aa, Artificial Sequence
  HA maturation cleavage fragment
NVPQIESRGLFGAIAGFIE

SEQ ID NO: 351 - protein, 19 aa, Artificial Sequence
  HA maturation cleavage fragment (B strain)
PAKLLKERGFFGAIAGFLE

SEQ ID NO: 352 - DNA, 1798 bp, Artificial Sequence
  STF2.4xH1C1
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgatggaatgggagaacatccctagcatccaatctcgcggcctgtttggcgctatcgcgggctttatcgaagaatgggagaacatcccgagcatccaatctcgcggtctgtttggtgcgatcgctggtttcatcgaggagtgggagaacattcctagcattcaaagccgtggcctgttcggcgctattgcaggttttattgaagaatgggaaaatatcccgtctatccaatcccgcggtctgttcggcgcgatcgcaggtttcattgaataataagctaagc

SEQ ID NO: 353 - DNA, 1738 bp, Artificial Sequence
  STF2.3xH1C1
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgatggaatgggaaaatatccctagcatccaatctcgcggtctgttcggtgctattgctggcttcatcgaggaatgggagaacatcccatctattcagtctcgcggcctgtttggtgcgatcgcgggttttattgaggaatgggaaaacattccaagcattcagtcacgtggtcttttcggcgccatcgctggttttatcgaatgataagcttagcccaagg

SEQ ID NO: 354 - DNA, 1672 bp, Artificial Sequence
  STF2.2xH1C1
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgatggaatgggaaaatatccctagcatccaatctcgcggtctgttcggtgctattgctggcttcatcgaggaatgggagaacatcccatctattcagtctcgcggcctgtttggtgcgatcgcgggttttattgagtgataagcttagcccaagg

SEQ ID NO: 355 - DNA, 1606 bp, Artificial Sequence
  STF2.1xH1C1
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgagcctgttagcgatggaatgggaaaatatccctagcatccaatctcgcggtctgttcggtgctattgctggcttcatcgagtgataagcttagcccaagg

SEQ ID NO: 356 - DNA, 1816 bp, Artificial Sequence
  STF2.4xH1C1
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttagcgggttgtggttccgagtgggaaaatattccgtctatccagagccgtggtctgttcggcgcaattgctggcttcattgaagaatgggaaaacatcccgtccatccagagccgtggcctgttcggcgccattgctggtttcatcgaggaatgggaaaacattccgtccatccagtcccgcggtctgtttggcgctatcgccggtttcattgaggaatgggaaaatatcccttccatccagtctcgtggtctgttcggcgcgattgcaggctttatcgaatctggttgctaataagctaagc

SEQ ID NO: 357 - protein, 78 aa, Bacterial lipoprotein of E. coli
MKATKLVLGAVILGSTLLAGCSSNAKIDQLSSDVQTLNAKVDQLSNDVNAMRSDVQAAKDDAARANQRLDNMATKYRK

SEQ ID NO: 358 - protein, 26 aa, Artificial Sequence
  H1C1 native peptide
SLWSEENIPSIQSRGLFGAIAGFIEE

SEQ ID NO: 359 - protein, 8 aa, Artificial Sequence
  TLR4 peptide
GGKSGRTG

SEQ ID NO: 360 - protein, 9 aa, Artificial Sequence
  TLR4 peptide
KGYDWLVVG

SEQ ID NO: 361 - protein, 10 aa, Artificial Sequence
  TLR4 peptide
EDMVYRIGVP

SEQ ID NO: 362 - protein, 6 aa, Artificial Sequence
  TLR4 peptide
VKLSGS

SEQ ID NO: 363 - protein, 8 aa, Artificial Sequence
  TLR4 peptide
GMLSLALF

SEQ ID NO: 364 - protein, 7 aa, Artificial Sequence
  TLR4 peptide
CVVGSVR

SEQ ID NO: 365 - protein, 8 aa, Artificial Sequence
  TLR4 peptide
IVRGCLGW

SEQ ID NO: 366 - protein, 8 aa, Artificial Sequence
  TLR4 peptide
AAEERTLG

SEQ ID NO: 367 - protein, 9 aa, Artificial Sequence
  TLR4 peptide
WARVVGWLR

SEQ ID NO: 368 - protein, 9 aa, Artificial Sequence
  TLR4 peptide
SEGYRLFGG

SEQ ID NO: 369 - protein, 10 aa, Artificial Sequence
  TLR4 peptide
LVGGVVRRGS

SEQ ID NO: 370 - protein, 10 aa, Artificial Sequence
  TLR4 peptide
GRVNDLWLAA

SEQ ID NO: 371 - protein, 10 aa, Artificial Sequence
  TLR4 peptide
SGWMLWREGS

SEQ ID NO: 372 - protein, 10 aa, Artificial Sequence
  TLR4 peptide
ERMEDRGGDL

SEQ ID NO: 373 - protein, 9 aa, Artificial Sequence
  TLR4 peptide
KLCCFTECM

SEQ ID NO: 374 - protein, 10 aa, Artificial Sequence
  TLR4 peptide
AVGSMERGRG

SEQ ID NO: 375 - protein, 9 aa, Artificial Sequence
  TLR4 peptide
RDWVGGDLV

SEQ ID NO: 376 - protein, 10 aa, Artificial Sequence
  TLR4 peptide
FFEVAKISQQ

SEQ ID NO: 377 - protein, 5 aa, Artificial Sequence
  TLR4 peptide
WWYWC

SEQ ID NO: 378 - protein, 7 aa, Artificial Sequence
  TLR4 peptide
MHLCSHA

SEQ ID NO: 379 - protein, 7 aa, Artificial Sequence
  TLR4 peptide
WLFRRIG

SEQ ID NO: 380 - protein, 7 aa, Artificial Sequence
  TLR4 peptide
YWFWRIG

SEQ ID NO: 381 - protein, 7 aa, Artificial Sequence
  TLR4 peptide
MHLYCIA

SEQ ID NO: 382 - protein, 8 aa, Artificial Sequence
  TLR4 peptide
WPLFPWIV

SEQ ID NO: 383 - protein, 7 aa, Artificial Sequence
  TLR4 peptide
DMRSHAR

SEQ ID NO: 384 - protein, 7 aa, Artificial Sequence
  TLR4 peptide
MHLCTHA

SEQ ID NO: 385 - protein, 6 aa, Artificial Sequence
  TLR4 peptide
NLFPFY

SEQ ID NO: 386 - protein, 7 aa, Artificial Sequence
  TLR4 peptide
MHLCTRA

SEQ ID NO: 387 - protein, 7 aa, Artificial Sequence
  TLR4 peptide
RHLWYHA

SEQ ID NO: 388 - protein, 7 aa, Artificial Sequence
  TLR4 peptide
WPFSAYW

SEQ ID NO: 389 - protein, 6 aa, Artificial Sequence
  TLR4 peptide
WYLRGS

SEQ ID NO: 390 - protein, 7 aa, Artificial Sequence
  TLR4 peptide
GKGTDLG

SEQ ID NO: 391 - protein, 6 aa, Artificial Sequence
  TLR4 peptide
IFVRMR

SEQ ID NO: 392 - protein, 7 aa, Artificial Sequence
  TLR4 peptide
WLFRPVF

SEQ ID NO: 393 - protein, 7 aa, Artificial Sequence
  TLR4 peptide
FLGWLMG

SEQ ID NO: 394 - protein, 7 aa, Artificial Sequence
  TLR4 peptide
MHLWHHA

SEQ ID NO: 395 - protein, 7 aa, Artificial Sequence
  TLR4 peptide
WWFPWKA

SEQ ID NO: 396 - protein, 7 aa, Artificial Sequence
  TLR4 peptide
WYLPWLG

SEQ ID NO: 397 - protein, 7 aa, Artificial Sequence
  TLR4 peptide
WPFPRTF

SEQ ID NO: 398 - protein, 7 aa, Artificial Sequence
  TLR4 peptide
WPFPAYW

SEQ ID NO: 399 - protein, 7 aa, Artificial Sequence
  TLR4 peptide
FLGLRWL

SEQ ID NO: 400 - protein, 10 aa, Artificial Sequence
  TLR4 peptide
SRTDVGVLEV

SEQ ID NO: 401 - protein, 10 aa, Artificial Sequence
  TLR4 peptide
REKVSRGDKG

SEQ ID NO: 402 - protein, 10 aa, Artificial Sequence
  TLR4 peptide
DWDAVESEYM

SEQ ID NO: 403 - protein, 10 aa, Artificial Sequence
  TLR4 peptide
VSSAQEVRVP

SEQ ID NO: 404 - protein, 10 aa, Artificial Sequence
  TLR4 peptide
LTYGGLEALG

SEQ ID NO: 405 - protein, 10 aa, Artificial Sequence
  TLR4 peptide
VEEYSSSGVS

SEQ ID NO: 406 - protein, 10 aa, Artificial Sequence
  TLR4 peptide
VCEVSDSVMA

SEQ ID NO: 407 - protein, 8 aa, Artificial Sequence
  TLR4 peptide
GGKSGRTG

SEQ ID NO: 408 - protein, 9 aa, Artificial Sequence
  TLR4 peptide
KGYDWLVVG

SEQ ID NO: 409 - protein, 10 aa, Artificial Sequence
  TLR4 peptide
EDMVYRIGVP

SEQ ID NO: 410 - protein, 6 aa, Artificial Sequence
  TLR4 peptide
VKLSGS

SEQ ID NO: 411 - protein, 8 aa, Artificial Sequence
  TLR4 peptide
GMLSLALF

SEQ ID NO: 412 - protein, 7 aa, Artificial Sequence
  TLR4 peptide
CVVGSVR

SEQ ID NO: 413 - protein, 8 aa, Artificial Sequence
  TLR4 peptide
IVRGCLGW

SEQ ID NO: 414 - protein, 8 aa, Artificial Sequence
  TLR4 peptide
AAEERTLG

SEQ ID NO: 415 - protein, 9 aa, Artificial Sequence
  TLR4 peptide
WARVVGWLR

SEQ ID NO: 416 - protein, 9 aa, Artificial Sequence
  TLR4 peptide
SEGYRLFGG

SEQ ID NO: 417 - protein, 10 aa, Artificial Sequence
  TLR4 peptide
LVGGVVRRGS

SEQ ID NO: 418 - protein, 10 aa, Artificial Sequence
  TLR4 peptide
GRVNDLWLAA

SEQ ID NO: 419 - protein, 10 aa, Artificial Sequence
  TLR4 peptide
SGWMLWREGS

SEQ ID NO: 420 - protein, 10 aa, Artificial Sequence
  TLR4 peptide
ERMEDRGGDL

SEQ ID NO: 421 - protein, 9 aa, Artificial Sequence
  TLR4 peptide
KLCCFTECM

SEQ ID NO: 422 - protein, 10 aa, Artificial Sequence
  TLR4 peptide
AVGSMERGRG

SEQ ID NO: 423 - protein, 9 aa, Artificial Sequence
  TLR4 peptide
RDWVGGDLV

SEQ ID NO: 424 - protein, 10 aa, Artificial Sequence
  TLR4 peptide
FFEVAKISQQ

SEQ ID NO: 425 - protein, 5 aa, Artificial Sequence
  TLR4 peptide
WWYWC

SEQ ID NO: 426 - protein, 7 aa, Artificial Sequence
  TLR4 peptide
MHLCSHA

SEQ ID NO: 427 - protein, 7 aa, Artificial Sequence
  TLR4 peptide
WLFRRIG

SEQ ID NO: 428 - protein, 7 aa, Artificial Sequence
  TLR4 peptide
YWFWRIG

SEQ ID NO: 429 - protein, 7 aa, Artificial Sequence
  TLR4 peptide
MHLYCIA

SEQ ID NO: 430 - protein, 8 aa, Artificial Sequence
  TLR4 peptide
WPLFPWIV

SEQ ID NO: 431 - protein, 7 aa, Artificial Sequence
  TLR4 peptide
DMRSHAR

SEQ ID NO: 432 - protein, 7 aa, Artificial Sequence
  TLR4 peptide
MHLCTHA

SEQ ID NO: 433 - protein, 6 aa, Artificial Sequence
  TLR4 peptide
NLFPFY

SEQ ID NO: 434 - protein, 7 aa, Artificial Sequence
  TLR4 peptide
MHLCTRA

SEQ ID NO: 435 - protein, 7 aa, Artificial Sequence
  TLR4 peptide
RHLWYHA

SEQ ID NO: 436 - protein, 7 aa, Artificial Sequence
  TLR4 peptide
WPFSAYW

SEQ ID NO: 437 - protein, 6 aa, Artificial Sequence
  TLR4 peptide
WYLRGS

SEQ ID NO: 438 - protein, 7 aa, Artificial Sequence
  TLR4 peptide
GKGTDLG

SEQ ID NO: 439 - protein, 6 aa, Artificial Sequence
  TLR4 peptide
IFVRMR

SEQ ID NO: 440 - protein, 7 aa, Artificial Sequence
  TLR4 peptide
WLFRPVF

SEQ ID NO: 441 - protein, 7 aa, Artificial Sequence
  TLR4 peptide
FLGWLMG

SEQ ID NO: 442 - protein, 7 aa, Artificial Sequence
  TLR4 peptide
MHLWHHA

SEQ ID NO: 443 - protein, 7 aa, Artificial Sequence
  TLR4 peptide
WWFPWKA

SEQ ID NO: 444 - protein, 7 aa, Artificial Sequence
  TLR4 peptide
WYLPWLG

SEQ ID NO: 445 - protein, 7 aa, Artificial Sequence
  TLR4 peptide
WPFPRTF

SEQ ID NO: 446 - protein, 7 aa, Artificial Sequence
  TLR4 peptide
WPFPAYW

SEQ ID NO: 447 - protein, 7 aa, Artificial Sequence
  TLR4 peptide
FLGLRWL

SEQ ID NO: 448 - protein, 10 aa, Artificial Sequence
  TLR4 peptide
SRTDVGVLEV

SEQ ID NO: 449 - protein, 10 aa, Artificial Sequence
  TLR4 peptide
REKVSRGDKG

SEQ ID NO: 450 - protein, 10 aa, Artificial Sequence
  TLR4 peptide
DWDAVESEYM

SEQ ID NO: 451 - protein, 10 aa, Artificial Sequence
  TLR4 peptide
VSSAQEVRVP

SEQ ID NO: 452 - protein, 10 aa, Artificial Sequence
  TLR4 peptide
LTYGGLEALG

SEQ ID NO: 453 - protein, 10 aa, Artificial Sequence
  TLR4 peptide
VEEYSSSGVS

SEQ ID NO: 454 - protein, 10 aa, Artificial Sequence
  TLR4 peptide
VCEVSDSVMA

SEQ ID NO: 455 - protein, 5 aa, Artificial Sequence
  TLR2 peptide
NPPTT

SEQ ID NO: 456 - protein, 5 aa, Artificial Sequence
  TLR2 peptide
MRRIL

SEQ ID NO: 457 - protein, 4 aa, Artificial Sequence
  TLR2 peptide
MISS

SEQ ID NO: 458 - protein, 5 aa, Artificial Sequence
  TLR2 peptide
RGGSK

SEQ ID NO: 459 - protein, 4 aa, Artificial Sequence
  TLR2 peptide
RGGF

SEQ ID NO: 460 - protein, 5 aa, Artificial Sequence
  TLR2 peptide
NRTVF

SEQ ID NO: 461 - protein, 5 aa, Artificial Sequence
  TLR2 peptide
NRFGL

SEQ ID NO: 462 - protein, 5 aa, Artificial Sequence
  TLR2 peptide
SRHGR

SEQ ID NO: 463 - protein, 5 aa, Artificial Sequence
  TLR2 peptide
IMRHP

SEQ ID NO: 464 - protein, 5 aa, Artificial Sequence
  TLR2 peptide
EVCAP

SEQ ID NO: 465 - protein, 5 aa, Artificial Sequence
  TLR2 peptide
ACGVY

SEQ ID NO: 466 - protein, 5 aa, Artificial Sequence
  TLR2 peptide
CGPKL

SEQ ID NO: 467 - protein, 5 aa, Artificial Sequence
  TLR2 peptide
AGCFS

SEQ ID NO: 468 - protein, 5 aa, Artificial Sequence
  TLR2 peptide
SGGLF

SEQ ID NO: 469 - protein, 5 aa, Artificial Sequence
  TLR2 peptide
AVRLS

SEQ ID NO: 470 - protein, 5 aa, Artificial Sequence
  TLR2 peptide
GGKLS

SEQ ID NO: 471 - protein, 5 aa, Artificial Sequence
  TLR2 peptide
VSEGV

SEQ ID NO: 472 - protein, 5 aa, Artificial Sequence
  TLR2 peptide
KCQSF

SEQ ID NO: 473 - protein, 5 aa, Artificial Sequence
  TLR2 peptide
FCGLG

SEQ ID NO: 474 - protein, 5 aa, Artificial Sequence
  TLR2 peptide
PESGV

SEQ ID NO: 475 - protein, 5 aa, Artificial Sequence
  TLR2 peptide
DPDSG

SEQ ID NO: 476 - protein, 5 aa, Artificial Sequence
  TLR2 peptide
IGRFR

SEQ ID NO: 477 - protein, 5 aa, Artificial Sequence
  TLR2 peptide
MGTLP

SEQ ID NO: 478 - protein, 5 aa, Artificial Sequence
  TLR2 peptide
ADTHQ

SEQ ID NO: 479 - protein, 5 aa, Artificial Sequence
  TLR2 peptide
HLLPG

SEQ ID NO: 480 - protein, 5 aa, Artificial Sequence
  TLR2 peptide
GPLLH

SEQ ID NO: 481 - protein, 5 aa, Artificial Sequence
  TLR2 peptide
NYRRW

SEQ ID NO: 482 - protein, 5 aa, Artificial Sequence
  TLR2 peptide
LRQGR

SEQ ID NO: 483 - protein, 5 aa, Artificial Sequence
  TLR2 peptide
IMWFP

SEQ ID NO: 484 - protein, 5 aa, Artificial Sequence
  TLR2 peptide
RVVAP

SEQ ID NO: 485 - protein, 5 aa, Artificial Sequence
  TLR2 peptide
IHVVP

SEQ ID NO: 486 - protein, 5 aa, Artificial Sequence
  TLR2 peptide
MFGVP

SEQ ID NO: 487 - protein, 5 aa, Artificial Sequence
  TLR2 peptide
CVWLQ

SEQ ID NO: 488 - protein, 5 aa, Artificial Sequence
  TLR2 peptide
IYKLA

SEQ ID NO: 489 - protein, 4 aa, Artificial Sequence
  TLR2 peptide
KGWF

SEQ ID NO: 490 - protein, 5 aa, Artificial Sequence
  TLR2 peptide
KYMPH

SEQ ID NO: 491 - protein, 5 aa, Artificial Sequence
  TLR2 peptide
VGKND

SEQ ID NO: 492 - protein, 5 aa, Artificial Sequence
  TLR2 peptide
THKPK

SEQ ID NO: 493 - protein, 5 aa, Artificial Sequence
  TLR2 peptide
SHIAL

SEQ ID NO: 494 - protein, 5 aa, Artificial Sequence
  TLR2 peptide
AWAGT

SEQ ID NO: 495 - protein, 20 aa, Artificial Sequence
  TLR2 peptide
KGGVGPVRRSSRLRRTTQPG

SEQ ID NO: 496 - protein, 23 aa, Artificial Sequence
  TLR2 peptide
GRRGLCRGCRTRGRIKQLQSAHK

SEQ ID NO: 497 - protein, 22 aa, Artificial Sequence
  TLR2 peptide
RWGYHLRDRKYKGVRSHKGVPR

SEQ ID NO: 498 - protein, 506 aa, S. typhimurium; identical to SEQ ID NO: 312

SEQ ID NO: 499 - DNA, 1518 bp, S. typhimurium; identical to SEQ ID NO: 178

SEQ ID NO: 500 - protein, 277 aa, S. typhimurium; identical to SEQ ID NO: 313

SEQ ID NO: 501 - DNA, 832 bp, S. typhimurium
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtg

SEQ ID NO: 502 - protein, 595 aa, E. coli
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDLTAAKMDAATNTITTTNNALTASKALDQLKDGDTVTIKADAAQTATVYTYNASAGNFSLSNVSNNTSEKAGDVAASLLPPAGQTASGVYKAASGEVNFDVDANGKITIGGQKAYLTSDGNLTTNDAGGATAATLDGLFKKAGDGQSIGFKKTASVTMGGTTYNFKTGADADAATANAGVSFTDTASKETVLNKVATAKQGKAAAADGDTSATITYKSGVQTYQAVFAAGDGTASAKYADKADVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 503 - DNA, 1788 bp, E. coli
atggcacaagtcattaataccaacagcctctcgctgatcactcaaaataatatcaacaagaaccagtctgcgctgtcgagttctatcgagcgtctgtcttctggcttgcgtattaacagcgcgaaggatgacgccgcaggtcaggcgattgctaaccgttttacttctaacattaaaggcctgactcaggctgcacgtaacgccaacgacggtatttccgttgcgcagaccaccgaaggcgcgctgtccgaaatcaacaacaacttacagcgtatccgtgaactgacggttcaggcttctaccgggactaactccgattcagatctggactccattcaggacgaaatcaaatcccgtctggacgaaattgaccgcgtatctggccagacccagttcaacggcgtgaacgtactggcgaaagacggttcaatgaaaattcaggttggtgcgaatgacggccagactatcacgattgatctgaagaaaattgactcagatacgctggggctgaatggttttaacgtgaatggttccggtacgatagccaataaagcggcgaccattagcgacctgacagcagcgaaaatggatgctgcaactaatactataactacaacaaataatgcgctgactgcatcaaaggcgcttgatcaactgaaagatggtgacactgttactatcaaagcagatgctgctcaaactgccacggtttatacatacaatgcatcagctggtaacttctcactcagtaatgtatcgaataatacttcagaaaaagcaggtgatgtagcagctagccttctcccgccggctgggcaaactgctagtggtgtttataaagcagcaagcggtgaagtgaactttgatgttgatgcgaatggtaaaatcacaatcggaggacagaaagcatatttaactagtgatggtaacttaactacaaacgatgctggtggtgcgactgcggctacgcttgatggtttattcaagaaagctggtgatggtcaatcaatcgggtttaagaagactgcatcagtcacgatggggggaacaacttataactttaaaacgggtgctgatgctgatgctgcaactgctaacgcaggggtatcgttcactgatacagctagcaaagaaaccgttttaaataaagtggctacagctaaacaaggcaaagcagctgcagctgacggtgatacatccgcaacaattacctataaatctggcgttcagacgtatcaggctgtatttgccgcaggtgacggtactgctagcgcaaaatatgccgataaagctgacgtttctaatgcaacagcaacatacactgatgctgatggtgaaatgactacaattggttcatacaccacgaagtattcaatcgatgctaacaacggcaaggtaactgttgattctggaactggtacgggtaaatatgcgccgaaagtaggggctgaagtatatgttagtgctaatggtactttaacaacagatgcaactagcgaaggcacagtaacaaaagatccactgaaagctctggatgaagctatcagctccatcgacaaattccgttcttccctgggtgctatccagaaccgtctggattccgcagtcaccaacctgaacaacaccactaccaacctgtccgaagcgcagtcccgtattcaggacgccgactatgcgaccgaagtgtccaacatgtcgaaagcgcagatcattcagcaggccggtaactccgtgctggcaaaagccaaccaggtaccgcagcaggttctgtctctgctgcagggttag

SEQ ID NO: 504 - protein, 506 aa, s. muenchen
MAQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLGLDKLNVQDAYTPKETAVTVDKTTYKNGTDTITAQSNTDIQTAIGGGATGVTGADIKFKDGQYYLDVKGGASAGVYKATYDETTKKVNIDTTDKTPLATAEATAIRGTATITHNQIAEVTKEGVDTTTVAAQLAAAGVTGADKDNTSLVKLSFEDKNGKVIDGGYAVKMGDDFYAATYDEKTGTITAKTTTYTDGAGVAQTGAVKFGGANGKSEVVTATDGKTYLASDLDKHNFRTGGELKEVNTDKTENPLQKIDAALAQVDTLRSDLGAVQNRFNSAITNLGNTVNNLSSARSRIEDSDYATEVSNMSRAQILQQAGTSVLAQANQVPQNVLSLLR

SEQ ID NO: 505 - DNA, 1522 bp, s. muenchen
aatggcacaagtcattaatacaaacagcctgtcgctgttgacccagaataacctgaacaaatcccagtccgctctgggcaccgctatcgagcgtctgtcttccggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacggtactaactcccagtctgaccttgactctatccaggctgaaatcacccagcgtctgaacgaaatcgaccgtgtatccggtcagactcagttcaacggcgtgaaagtcctggcgcaggacaacaccctgaccatccaggttggtgccaacgacggtgaaactattgatattgatttaaaagaaattagctctaaaacactgggacttgataagcttaatgtccaggatgcctacaccccgaaagaaactgctgtaaccgttgataaaactacctataaaaatggtacagatactattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttagcaactgcggaagctacagctattcggggaacggccactataacccacaaccaaattgctgaagtaacaaaagagggtgttgatacgaccacagttgcggctcaacttgctgctgcaggggttactggtgccgataaggacaatactagccttgtaaaactatcgtttgaggataaaaacggtaaggttattgatggtggctatgcagtgaaaatgggcgacgatttctatgccgctacatatgatgagaaaacaggtacaattactgctaaaacaaccacttatacagatggtgctggcgttgctcaaactggagctgtgaaatttggtggcgcaaatggtaaatctgaagttgttactgctaccgatggtaaaacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggtacagaaccgtttcaactccgctatcaccaacctgggcaataccgtaaataacctgtcttctgcccgtagccgtatcgaagattccgactacgcgaccgaagtctccaacatgtctcgcgcgcagattctgcagcaggccggtacctccgttctggcgcaggctaaccaggttccgcaaaacgtcctctctttactgcgttaa

SEQ ID NO: 506 - protein, 588 aa, Artificial Sequence
  pMT/STF2
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRKGNSKLEGQLEFPRTSPVWWNSADIQHSGGRSSLEGPRFEGKPIPNPLLGLDSTRTGHHHHHH

SEQ ID NO: 507 - DNA, 1764 bp, Artificial Sequence
  pMT/STF2
atgaagttatgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtaagggcaattcgaagcttgaaggtcaattggaattccctaggactagtccagtgtggtggaattctgcagatatccagcacagtggcggccgctcgagtctagagggcccgcggttcgaaggtaagcctatccctaaccctctcctcggtctcgattctacgcgtaccggtcatcatcaccatcaccat

SEQ ID NO: 508 - protein, 97 aa, Artificial Sequence
  M2 Influenza A
MSLLTEVETPIRNEWGCRCNDSSDPLVVAASIIGILHLILWILDRLFFKCIYRLFKHGLKRGPSTEGVPESMREEYRKEQQNAVDADDSHFVSIELE

SEQ ID NO: 509 - DNA, 294 bp, Artificial Sequence
  M2 Influenza A
atgagccttctaaccgaggtcgaaacacctatcagaaacgaatgggggtgcagatgcaacgattcaagtgacccgcttgttgttgccgcgagtatcattgggatcttgcacttgatattgtggattcttgatcgtctttttttcaaatgcatctatcgactcttcaaacacggccttaaaagagggccttctacggaaggagtacctgagtctatgagggaagaatatcgaaaggaacagcagaatgctgtggatgctgacgacagtcattttgtcagcatagagttggagtaa

SEQ ID NO: 510 - protein, 24 aa, Artificial Sequence
  M2
SLLTEVETPIRNEWGCRCNDSSDP

SEQ ID NO: 511 - DNA, 75 bp, Artificial Sequence
  M2
atgagcctgctgaccgaggtcgaaacaccgatccgcaacgaatgggggtgccgctgcaacgattcaagtgacccg

SEQ ID NO: 512 - protein, 11 aa, Artificial Sequence
  M2
EVETPIRNEWG

SEQ ID NO: 513 - DNA, 30 bp, Artificial Sequence
  M2
gaggtcgaaacacctatcagaaacgaatgg

SEQ ID NO: 514 - DNA, 315 bp, Artificial Sequence
  4XM2e
agcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataa

SEQ ID NO: 515 - protein, 104 aa, Artificial Sequence
  4XM2e
SLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 516 - protein, 9 aa, Artificial Sequence
  M2
EVETPIRNE

SEQ ID NO: 517 - protein, 8 aa, Artificial Sequence
  M2
EVETPIRN

SEQ ID NO: 518 - protein, 24 aa, Artificial Sequence
  M2
MKATKLVLGAVILGSTLLAGCSSN

SEQ ID NO: 519 - DNA, 75 bp, Artificial Sequence
  M2
atgaaagctactaaactggtactgggcgcggtaatcctgggttctactctgctgctggcaggttgctccagcaac

SEQ ID NO: 520 - DNA, 48 bp, Artificial Sequence
  Linker
aagggcaattcgaagcttgaaggtcaattggaattccctaggactagt

SEQ ID NO: 521 - protein, 16 aa, Artificial Sequence
  Linker
KGNSKLEGQLEFPRTS

SEQ ID NO: 522 - DNA, 36 bp, Artificial Sequence
  Linker
gaattctgcagatatccagcacagtggcggccgctc

SEQ ID NO: 523 - protein, 12 aa, Artificial Sequence
  Linker
EFCRYPAQWRPL

SEQ ID NO: 524 - protein, 12 aa, Artificial Sequence
  Linker
EFSRYPAQWRPL

SEQ ID NO: 525 - DNA, 36 bp, Artificial Sequence
  Linker
gaattctctagatatccagcacagtggcggccgctc

SEQ ID NO: 526 - protein, 45 aa, Artificial Sequence
  Linker
KGNSKLEGQLEFPRTSPVWWNSADIQHSGGRQCDGYLQNSPLRPL

SEQ ID NO: 527 - DNA, 135 bp, Artificial Sequence
  Linker
aagggcaattcgaagcttgaaggtcaattggaattccctaggactagtccagtgtggtggaattctgcagatatccagcacagtggcggccgccagtgtgatggatatctgcagaattcgcccttgcggccgctc

SEQ ID NO: 528 - protein, 611 aa, Artificial Sequence; identical to SEQ ID NO: 94
  STF2-4XM2e

SEQ ID NO: 529 - DNA, 1836 bp, Artificial Sequence
  STF2-4XM2e
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctgagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataa

SEQ ID NO: 530 - protein, 19 aa, Artificial Sequence
  HA
PAKLLKERGRRGAIAGFLE

SEQ ID NO: 531 - protein, 10 aa, Artificial Sequence
  HA
EVETPIRNEW

SEQ ID NO: 532 - protein, 26 aa, Artificial Sequence
  HA FluB
SLWSEEPAKLLKERGFFGAIAGFLEE

SEQ ID NO: 533 - protein, 26 aa, Artificial Sequence
  HA FluA H1/H0
SLWSEENIPSIQSRGLFGAIAGFIEE

SEQ ID NO: 534 - protein, 26 aa, Artificial Sequence
  HA FluA H3/H0
SLWSEENVPEKQTRGIFGAIAGFIEE

SEQ ID NO: 535 - protein, 30 aa, Artificial Sequence
  HA Flu A H5/H0
SLWSEEEWEERERRRKKRGLFGAIAGFIEE

SEQ ID NO: 536 - protein, 24 aa, Artificial Sequence
  M2
SLLTEVETPTRNEWESRSSDSSDP

SEQ ID NO: 537 - protein, 24 aa, Artificial Sequence
  M2
SLLTEVETPTRNEWECRCSDSSDP

SEQ ID NO: 538 - protein, 24 aa, Artificial Sequence
  M2
SLLTEVETLTRNGWGSRSSDSSDP

SEQ ID NO: 539 - protein, 24 aa, Artificial Sequence
  M2
SLLTEVETLTRNGWGCRCSDSSDP

SEQ ID NO: 540 - protein, 24 aa, Artificial Sequence
  M2
SLLTEVETPTRNGWESKSSDSSDP

SEQ ID NO: 541 - protein, 24 aa, Artificial Sequence
  M2
SLLTEVETPTRNGWECKCSDSSDP

SEQ ID NO: 542 - protein, 24 aa, Artificial Sequence
  M2
SLLTEVETLTRNGWESKSRDSSDP

SEQ ID NO: 543 - protein, 24 aa, Artificial Sequence
  M2
SLLTEVETLTRNGWECKCRDSSDP

SEQ ID NO: 544 - protein, 24 aa, Artificial Sequence
  M2
SLLTEVETPIRNEWGSRSNDSSDP

SEQ ID NO: 545 - protein, 24 aa, Artificial Sequence
  M2
SLLTEVETPIRNEWGCRCNGSSDP

SEQ ID NO: 546 - protein, 24 aa, Artificial Sequence
  M2
SLLTEVETPIRNEWGCKCNDSSDP

SEQ ID NO: 547 - protein, 24 aa, Artificial Sequence
  M2
SLLTEVETPIRNEWGCRCNDSSDP

SEQ ID NO: 548 - protein, 24 aa, Artificial Sequence
  M2
SLLTEVETPIRNEWGCRCNDSSDP

SEQ ID NO: 549 - protein, 24 aa, Artificial Sequence
  M2
SLLTEVETPIRNEWECRCNGSSDP

SEQ ID NO: 550 - protein, 24 aa, Artificial Sequence
  M2
SLLTEVETPTRNEWECRCSDSSDP

SEQ ID NO: 551 - protein, 24 aa, Artificial Sequence
  M2
SLLTEVETPIRNEWGSRSNGSSDP

SEQ ID NO: 552 - protein, 24 aa, Artificial Sequence
  M2
SLLTEVETLTRNGWGCRCSDSSDP

SEQ ID NO: 553 - protein, 24 aa, Artificial Sequence
  M2
SLLTEVETPTRNEWECRCSDSSDP

SEQ ID NO: 554 - protein, 24 aa, Artificial Sequence
  M2
SLLTEVETPTRNGWECKCSDSSDP

SEQ ID NO: 555 - protein, 24 aa, Artificial Sequence
  M2
SLLTEVETPTRNGWGCRCSGSSDP

SEQ ID NO: 556 - protein, 24 aa, Artificial Sequence
  M2
SLLTEVETLTRNGWECKCRDSSDP

SEQ ID NO: 557 - protein, 811 aa, Artificial Sequence
  STF2delta.HA
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYST

SEQ ID NO: 558 - DNA, 2439 bp, Artificial Sequence
  STF2delta.HA
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcgaccagatctgtatcggttatcatgctaacaattctactgaacaagtagatactatcatggagaagaacgttacagttacacatgcacaagatatcctggaaaagaagcataatggaaaactgtgtgaccttgatggtgttaaaccactaatattgcgtgactgctcagttgctgggtggttgttggggaatccaatgtgcgacgaatttatcaacgttccagaatggagttacattgttgaaaaagctaaccctgttaacgacttgtgttacccaggcgattttaatgactacgaggaacttaagcatttgttgtcaagaattaaccacttcgagaaaattcaaattattccaaagtcatcttggtcctcccatgaagcatccctaggagtctcttccgcttgcccttaccaaggcaagagttccttttttcgtaatgtcgtctggctgatcaaaaagaactccacctatccaactataaagagatcatacaacaacacaaatcaggaggatctgctagttctgtggggcattcaccaccccaatgacgcagctgagcagactaaattgtaccaaaacccaactacctatatatcagttggtacctcaactcttaaccagcgactagtcccccgtattgctactaggtcaaaggttaatggtcaaagtggacgaatggagtttttctggactattttgaagcccaacgatgccatcaacttcgaaagtaatggaaatttcatagcccctgagtacgcttacaaaatcgttaaaaagggtgattccactatcatgaaatctgaactggaatacggaaactgtaacaccaaatgccagacgccaatgggtgccatcaactcttctatgccttttcacaacattcatcctttgactattggtgaatgcccaaagtacgtcaaatctaaccgtttggtgttggctactggtctaaggaactcccctcagcgtgaaagaagaagaaagaagaggggattattcggtgctatcgctggatttattgagggaggatggcagggaatggtcgatggctggtatggttaccatcactcaaatgaacagggaagtggatacgcagctgataaagaatctactcaaaaggctatcgacggtgttacaaacaaggtcaattctattatcgataagatgaatacacagtttgaggctgttggtagagagttcaataatcttgagagaagaatcgaaaacctgaacaagaaaatggaagacggatttttagatgtatggacttacaatgctgagttgttggtcttgatggagaatgaacgaacgttggacttccatgactccaatgtgaagaacctatatgacaaagtgaggctgcaacttagagacaacgccaaggaattgggaaacgggtgcttcgagttttaccacaaatgcgacaacgaatgtatggaatcagtgagaaacggtacctatgattacccccaatattccgaggaggcaagactgaagagagaagagatatctggtgtaaagttggaatccatcggtatttatcagattctatctatatattctacctaatag

SEQ ID NO: 559 - protein, 800 aa, Artificial Sequence; identical to SEQ ID NO: 177
  STF2delta.HA (PR8)

SEQ ID NO: 560 - DNA, 2439 bp, Artificial Sequence; identical to SEQ ID NO: 558
  STF2delta.HA (PR8)

SEQ ID NO: 561 - protein, 511 aa, Artificial Sequence; identical to SEQ ID NO: 23
  HA (PR8)

SEQ ID NO: 562 - DNA, 1572 bp, Artificial Sequence
  HA (PR8)
gaccagatctgtatcggttatcatgctaacaattctactgaacaagtagatactatcatggagaagaacgttacagttacacatgcacaagatatcctggaaaagaagcataatggaaaactgtgtgaccttgatggtgttaaaccactaatattgcgtgactgctcagttgctgggtggttgttggggaatccaatgtgcgacgaatttatcaacgttccagaatggagttacattgttgaaaaagctaaccctgttaacgacttgtgttacccaggcgattttaatgactacgaggaacttaagcatttgttgtcaagaattaaccacttcgagaaaattcaaattattccaaagtcatcttggtcctcccatgaagcatccctaggagtctcttccgcttgcccttaccaaggcaagagttccttttttcgtaatgtcgtctggctgatcaaaaagaactccacctatccaactataaagagatcatacaacaacacaaatcaggaggatctgctagttctgtggggcattcaccaccccaatgacgcagctgagcagactaaattgtaccaaaacccaactacctatatatcagttggtacctcaactcttaaccagcgactagtcccccgtattgctactaggtcaaaggttaatggtcaaagtggacgaatggagtttttctggactattttgaagcccaacgatgccatcaacttcgaaagtaatggaaatttcatagcccctgagtacgcttacaaaatcgttaaaaagggtgattccactatcatgaaatctgaactggaatacggaaactgtaacaccaaatgccagacgccaatgggtgccatcaactcttctatgccttttcacaacattcatcctttgactattggtgaatgcccaaagtacgtcaaatctaaccgtttggtgttggctactggtctaaggaactcccctcagcgtgaaagaagaagaaagaagaggggattattcggtgctatcgctggatttattgagggaggatggcagggaatggtcgatggctggtatggttaccatcactcaaatgaacagggaagtggatacgcagctgataaagaatctactcaaaaggctatcgacggtgttacaaacaaggtcaattctattatcgataagatgaatacacagtttgaggctgttggtagagagttcaataatcttgagagaagaatcgaaaacctgaacaagaaaatggaagacggatttttagatgtatggacttacaatgctgagttgttggtcttgatggagaatgaacgaacgttggacttccatgactccaatgtgaagaacctatatgacaaagtgaggctgcaacttagagacaacgccaaggaattgggaaacgggtgcttcgagttttaccacaaatgcgacaacgaatgtatggaatcagtgagaaacggtacctatgattacccccaatattccgaggaggcaagactgaagagagaagagatatctggtgtaaagttggaatccatcggtatttatcagattctatctatatattctacctaatag

SEQ ID NO: 563 - protein, 261 aa, E. coli
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 564 - protein, 522 aa, Artificial Sequence
  H5N1 HA
DQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYST

SEQ ID NO: 565 - DNA, 1572 bp, Artificial Sequence; identical to SEQ ID NO: 562
  H5N1 HA

SEQ ID NO: 566 - DNA, 43 bp, Artificial Sequence
  Primer
  m = a or c
cgctcttcamtgagcttgctgactgaggttgagaccccgattc

SEQ ID NO: 567 - DNA, 50 bp, Artificial Sequence
  Primer
cgctcttcacgcttattatctagacgggtctgagctatcgttagagcgag

SEQ ID NO: 568 - DNA, 41 bp, Artificial Sequence
  Primer
gctcttcagcggctgagcaataactagcataaccccttggg

SEQ ID NO: 569 - DNA, 39 bp, Artificial Sequence
  Primer
cgctcttcacagacgtaacagagacagcacgttctgcgg

SEQ ID NO: 570 - protein, 24 aa, Artificial Sequence
  M2
SLLTEVETPIRNEWGSKSNDSSDP

SEQ ID NO: 571 - protein, 24 aa, Artificial Sequence
  M2
SLLTEVETPIRNEWGSRSNDSSDP

SEQ ID NO: 572 - protein, 24 aa, Artificial Sequence
  M2
SLLTEVETPIRNEWESRSNGSSDP

SEQ ID NO: 573 - protein, 24 aa, Artificial Sequence
  M2
SLLTEVETPTRNEWESRSSDSSDP

SEQ ID NO: 574 - protein, 24 aa, Artificial Sequence
  M2
SLLTEVETLTRNGWGSRSSDSSDP

SEQ ID NO: 575 - protein, 24 aa, Artificial Sequence
  M2
SLLTEVETPTRNEWESRSSDSSDP

SEQ ID NO: 576 - protein, 24 aa, Artificial Sequence
  M2
SLLTEVETPTRNGWESKSSDSSDP

SEQ ID NO: 577 - protein, 24 aa, Artificial Sequence
  M2
SLLTEVETPTRNGWGSRSSGSSDP

SEQ ID NO: 578 - protein, 24 aa, Artificial Sequence
  M2
SLLTEVETLTRNGWESKSRDSSDP

SEQ ID NO: 579 - protein, 641 aa, Artificial Sequence
  pMT/STF2.4XM2e (H1)
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRKGNSKLEGQLEFSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 580 - DNA, 1926 bp, Artificial Sequence
  pMT/STF2.4XM2e (H1)
atgaagttatgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtaagggcaattcgaagcttgaaggtcaattggaattcagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataa

SEQ ID NO: 581 - protein, 641 aa, Artificial Sequence
  pMT/STF2.4XM2e (H5)
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRKGNSKLEGQLEFSLLTEVETPTRNEWESRSSDSSDPLESLLTEVETPTRNEWESRSSDSSDPESSLLTEVETPTRNEWESRSSDSSDPGSSLLTEVETPTRNEWESRSSDSSDPSR

SEQ ID NO: 582 - DNA, 1927 bp, Artificial Sequence
  pMT/STF2.4XM2e (H5)
atgaagttatgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtaagggcaattcgaagcttgaaggtcaattggaattctctctgctgactgaagtagaaactccaacgcgtaatgaatgggaatcccgttctagcgactcctctgatcctctcgagtccctgctgacggaggttgaaaccccgacccgcaacgagtgggaaagccgttcctccgattcctctgatccggagagcagcctgctgaccgaggtagaaaccccgacccgtaatgagtgggaatctcgctcctctgattcttctgacccgggatcctctctgctgaccgaagtggagactccgactcgcaacgaatgggagagccgttcttctgactcctctgacccgtctagataat

SEQ ID NO: 583 - protein, 749 aa, Artificial Sequence
  pMT/STF2.4XM2e (H1 H5)
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRKGNSKLEGQLEFSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSRSREFSLLTEVETPTRNEWESRSSDSSDPLESLLTEVETPTRNEWESRSSDSSDPESSLLTEVETPTRNEWESRSSDSSDPGSSLLTEVETPTRNEWESRSSDSSDPSR

SEQ ID NO: 584 - DNA, 2250 bp, Artificial Sequence
  pMT/STF2.4XM2e (H1 H5)
atgaagttatgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtaagggcaattcgaagcttgaaggtcaattggaattcagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagatctagagaattctctctgctgactgaagtagaaactccaacgcgtaatgaatgggaatcccgttctagcgactcctctgatcctctcgagtccctgctgacggaggttgaaaccccgacccgcaacgagtgggaaagccgttcctccgattcctctgatccggagagcagcctgctgaccgaggtagaaaccccgacccgtaatgagtgggaatctcgctcctctgattcttctgacccgggatcctctctgctgaccgaagtggagactccgactcgcaacgaatgggagagccgttcttctgactcctctgacccgtctagataa

SEQ ID NO: 585 - protein, 318 aa, Artificial Sequence
  pMT/STF2delta
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLTRTGHHHHHH

SEQ ID NO: 586 - DNA, 957 bp, Artificial Sequence
  pMT/STF2delta
atgaagttatgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcacgcgtaccggtcatcatcaccatcaccattga

SEQ ID NO: 587 - protein, 402 aa, Artificial Sequence
  pMT/STF2delta.4XM2e (H1)
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSR

SEQ ID NO: 588 - DNA, 1203 bp, Artificial Sequence
  pMT/STF2delta.4XM2e (H1)
atgtgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattcagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagataa

SEQ ID NO: 589 - protein, 402 aa, Artificial Sequence
  pMT/STF2delta.4XM2e (H5)
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSLLTEVETPTRNEWESRSSDSSDPLESLLTEVETPTRNEWESRSSDSSDPESSLLTEVETPTRNEWESRSSDSSDPGSSLLTEVETPTRNEWESRSSDSSDPSR

SEQ ID NO: 590 - DNA, 1206 bp, Artificial Sequence
  pMT/STF2delta.4XM2e (H5)
atgtgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctctgctgactgaagtagaaactccaacgcgtaatgaatgggaatcccgttctagcgactcctctgatcctctcgagtccctgctgacggaggttgaaaccccgacccgcaacgagtgggaaagccgttcctccgattcctctgatccggagagcagcctgctgaccgaggtagaaaccccgacccgtaatgagtgggaatctcgctcctctgattcttctgacccgggatcctctctgctgaccgaagtggagactccgactcgcaacgaatgggagagccgttcttctgactcctctgacccgtctagataataa

SEQ ID NO: 591 - protein, 508 aa, Artificial Sequence
  pMT/STF2delta.4XM2e (H1H5)
MKLCILLAVVAFVGLSLGRSAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSLLTEVETPIRNEWGSRSNDSSDPLESLLTEVETPIRNEWGSRSNDSSDPGSSLLTEVETPIRNEWGSRSNDSSDPELSLLTEVETPIRNEWGSRSNDSSDPSRQFSLLTEVETPTRNEWESRSSDSSDPLESLLTEVETPTRNEWESRSSDSSDPESSLLTEVETPTRNEWESRSSDSSDPGSSLLTEVETPTRNEWESRSSDSSDPSR

SEQ ID NO: 592 - DNA, 1527 bp, Artificial Sequence
  pMT/STF2delta.4XM2e (H1H5)
atgtgcatattactggccgtcgtggcctttgttggcctctcgctcgggagatctgcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattcagcttgctgactgaggttgagaccccgattcgcaacgaatggggttcccgttccaacgattcttccgacccgctcgagagcctgttgaccgaggttgaaacccctatccgtaatgaatggggctcccgtagcaacgactcttctgacccaggatcctccctcttgaccgaagtggaaacgcctattcgtaatgagtggggttctcgtagcaatgacagctcggacccggagctctcgctgctgacggaagtggagactccgatccgtaacgagtggggctctcgctctaacgatagctcagacccgtctagatctagagaattctctctgctgactgaagtagaaactccaacgcgtaatgaatgggaatcccgttctagcgactcctctgatcctctcgagtccctgctgacggaggttgaaaccccgacccgcaacgagtgggaaagccgttcctccgattcctctgatccggagagcagcctgctgaccgaggtagaaaccccgacccgtaatgagtgggaatctcgctcctctgattcttctgacccgggatcctctctgctgaccgaagtggagactccgactcgcaacgaatgggagagccgttcttctgactcctctgacccgtctagataa

SEQ ID NO: 593 - DNA, 33 bp, Artificial Sequence
  M2
gaggttgagaccccgattcgcaacgaatggggt

SEQ ID NO: 594 - protein, 10 aa, Artificial Sequence
  Linker
GAPVDPASPW

SEQ ID NO: 595 - protein, 277 aa, Artificial Sequence
  S. muenchen
MAQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLDKHNFRTGGELKEVNTDKTENPLQKIDAALAQVDTLRSDLGAVQNRFNSAITNLGNTVNNLSSARSRIEDSDYATEVSNMSRAQILQQAGTSVLAQANQVPQNVLSLLR

SEQ ID NO: 596 - DNA, 789 bp, Artificial Sequence
  S. muenchen
atggcacaagtcattaatacaaacagcctgtcgctgttgacccagaataacctgaacaaatcccagtccgctctgggcaccgctatcgagcgtctgtcttccggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacggtactaactcccagtctgaccttgactctatccaggctgaaatcacccagcgtctgaacgaaatcgaccgtgtatccggtcagactcagttcaacggcgtgaaagtcctggcgcaggacaacaccctgaccatccaggttggtgccaacgacggtgaaactattgatattgatttaaaagaaattagctctaaaacactgacagataagactgaaaacccactgcagaaaattgatgctgccttggcacaggttgatacacttcgttctgacctgggtgcggtacagaaccgtttcaactccgctatcaccaacctgggcaataccgtaaataacctgtcttctgcccgtagccgtatcgaagattccgactacgcgaccgaagtctccaacatgtctcgcgcgcagattctgcagcaggccggtacctccgttctggcgcaggctaaccaggttccgcaaaacgtcctctctttactgcgttaa

SEQ ID NO: 597 - protein, 102 aa, Artificial Sequence
  H1 and H5
SLLTEVETPTRNEWESRSSDSSDPLESLLTEVETPTRNEWESRSSDSSDPESSLLTEVETPTRNEWESRSSDSSDPGSSLLTEVETPTRNEWESRSSDSSDP

SEQ ID NO: 598 - DNA, 306 bp, Artificial Sequence
  H1 and H5
tctctgctgactgaagtagaaactccaacgcgtaatgaatgggaatcccgttctagcgactcctctgatcctctcgagtccctgctgacggaggttgaaaccccgacccgcaacgagtgggaaagccgttcctccgattcctctgatccggagagcagcctgctgaccgaggtagaaaccccgacccgtaatgagtgggaatctcgctcctctgattcttctgacccgggatcctctctgctgaccgaagtggagactccgactcgcaacgaatgggagagccgttcttctgactcctctgacccg

SEQ ID NO: 599 - protein, 20 aa, Artificial Sequence
  HA
PAKLLKERGFFGAIAGFLEE

SEQ ID NO: 600 - protein, 20 aa, Artificial Sequence
  HA
NIPSIQSRGLFGAIAGFIEE

SEQ ID NO: 601 - protein, 20 aa, Artificial Sequence
  HA
NVPEKQTRGIFGAIAGFIEE

SEQ ID NO: 602 - protein, 20 aa, Artificial Sequence
  HA
RERRRKKRGLFGAIAGFIEE

SEQ ID NO: 603 - DNA, 72 bp, Artificial Sequence
  M2
agcttgctgactgaggttgagaccccgattcgcaacgaatggggttcccgttccaacgattcttccgacccg

SEQ ID NO: 604 - protein, 506 aa, S. typhimurium; identical to SEQ ID NO: 312

SEQ ID NO: 605 - DNA, 1517 bp, S. typhimurium
tggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgt

SEQ ID NO: 606 - protein, 277 aa, S. typhimurium; identical to SEQ ID NO: 313

SEQ ID NO: 607 - DNA, 832 bp, S. typhimurium; identical to SEQ ID NO: 501

SEQ ID NO: 608 - DNA, 1215 bp, Artificial Sequence
  pET/STF2delta.JEIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctgcagatatccagcacagtggcggccgctcatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggcc

SEQ ID NO: 609 - protein, 405 aa, Artificial Sequence
  pET/STF2delta.JEIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFCRYPAQWRPLMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 610 - protein, 115 aa, Artificial Sequence
  West Nile domain III
MEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 611 - protein, 103 aa, Artificial Sequence
  West Nile domain III
GTTYGVCSKAFKFARTPADTGHGTVVLELQYTGKDGPCKVPISSVASLNDLTPVGRLVTVNPFVSVATANSKVLIELEPPFGDSYIVVGRGEQQINHHWHKSG

SEQ ID NO: 612 - protein, 102 aa, Artificial Sequence
  West Nile domain III
GTTYGVCSKAFKFLGTPADTGHGTVVLELQYTGTDGPCKVPISSVASLNDLTPVGRLVTVNPFVSVATANAKVLIELEPPFGDSYVVGRGEQQINHHWHKSG

SEQ ID NO: 613 - protein, 27 aa, Artificial Sequence
  West Nile domain III
ELEPPFGDSYIVVGRGEQQINHHWHKS

SEQ ID NO: 614 - DNA, 345 bp, Artificial Sequence
  West Nile domain III
atggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 615 - protein, 96 aa, Artificial Sequence
  Langat virus
GLTYTVCDKTKFTWKRAPTDSGHDTVVMEVGFSGTRPCRIPVRAVAHGVPEVNVAMLITPNPTMENNGGGFIEMQLPPGDNIIYVGDLNHQWFQKG

SEQ ID NO: 616 - protein, 103 aa, Artificial Sequence
  Kunjin virus
GTTYGVCSKAFRFLGTPADTGHGTVVLELQYTGTDGPCKIPISSVASLNDLTPVGRLVTVNPFVSVSTANAKVLIELEPPFGDSYIVVGRGEQQINHHWHKSG

SEQ ID NO: 617 - protein, 103 aa, Artificial Sequence
  Murray Valley virus
GTTYGMCTEKFTFSKNPADTGHGTVVLELQYTGSDGPCKIPISSVASLNDMTPVGRMVTANPYVASSTANAKVLVEIEPPFGDSYIVVGRGDKQINHHWHKEG

SEQ ID NO: 618 - protein, 103 aa, Artificial Sequence
  Japanese encephalitis virus
GTTYGMCTEKFSFAKNPADTGHGTVVIELSYSGSDGPCKIPIVSVASLNDMTPVGRLVTVNPFVATSSANSKVLVEMEPPFGSDYIVVGMGDKQINHHWHKAG

SEQ ID NO: 619 - protein, 26 aa, Artificial Sequence
  Japanese encephalitis virus
EMEPPFGDSYIVVMGDKQINHHWHKA

SEQ ID NO: 620 - protein, 95 aa, Artificial Sequence
  Tick-borne encephalitis virus
GLTYTMCDKTKFTWKRAPTDSGHDTVVMEVTFSGTKPCRIPVRAVAHGSPDVNVAMLITPNPTIENNGGGFIEMQLPPGDNIIYVGELSHQWFQK

SEQ ID NO: 621 - protein, 94 aa, Artificial Sequence
  Yellow fever virus
GLTYTMCDKTFTWKRAPTDSGHDTVVMEVTFSGTKPCRIPVRAVAHGSPDVNVAMLITPNPTIENNGGGFIEMQLPPGDNIIYVGELSHQWFQK

SEQ ID NO: 622 - protein, 95 aa, Artificial Sequence
  Envelope protein flavivirus
GTTYGMCSKKFTFRPADTGHGTVVLELQYSGDGPCKIPISVASKNDLTPVGRLVTVNPFVSSTANAKVLIEMEPPFGDSYIVVGGEQINHHWHKG

SEQ ID NO: 623 - protein, 27 aa, Artificial Sequence
  Dengue virus
EAEPPFGESYIVVGAGEKALKLSWFKK

SEQ ID NO: 624 - protein, 27 aa, Artificial Sequence
  Dengue virus
ETEPPFGESYIVVGAGEKALKLSWFKK

SEQ ID NO: 625 - protein, 27 aa, Artificial Sequence
  Dengue virus
EAEPPFGDSYIIIGVEPQQLKLNWFKK

SEQ ID NO: 626 - protein, 27 aa, Artificial Sequence
  Dengue virus
EAEPPFGESNIVIGIGDKALKINWYKK

SEQ ID NO: 627 - protein, 27 aa, Artificial Sequence
  Dengue virus
ELEPPFGESYIVIGVGNSALTLHWFRK

SEQ ID NO: 628 - DNA, 48 bp, Artificial Sequence; identical to SEQ ID NO: 520
  Linker

SEQ ID NO: 629 - protein, 16 aa, Artificial Sequence
  Linker
KGNSKLEGQLEFPRTS

SEQ ID NO: 630 - DNA, 36 bp, Artificial Sequence; identical to SEQ ID NO: 522
  Linker

SEQ ID NO: 631 - protein, 12 aa, Artificial Sequence
  Linker
EFCRYPAQWRPL

SEQ ID NO: 632 - DNA, 1863 bp, Artificial Sequence
  STF2.EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 633 - protein, 621 aa, Artificial Sequence
  STF2.EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 634 - DNA, 1176 bp, Artificial Sequence
  STF2delta.EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 635 - protein, 392 aa, Artificial Sequence
  STF2delta.EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLRMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 636 - DNA, 1224 bp, Artificial Sequence
  STF2delta.EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctgcagatatccagcacagtggcggccgctcatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaacccttaataagc

SEQ ID NO: 637 - protein, 408 aa, Artificial Sequence
  STF2delta.EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFCRYPAQWRPLMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKPLIS

SEQ ID NO: 638 - DNA, 1899 bp, Artificial Sequence
  STF2.EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtgaattctgcagatatccagcacagtggcggccgctcatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 639 - protein, 633 aa, Artificial Sequence
  STF2.EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLREFCRYPAQWRPLMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 640 - DNA, 1143 bp, Artificial Sequence
  STF2delta.EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 641 - protein, 381 aa, Artificial Sequence
  STF2delta.EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVTENPLQKIDAALAQVDALRSDLGAVQNRFNSAITNLGNTVNNLSEARSRIEDSDYATEVSNMSRAQILQQAGTSVLAQANQVPQNVLSLLRMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 642 - protein, 406 aa, Artificial Sequence
  West Nile virus envelope
FNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 643 - protein, 99 aa, Artificial Sequence
  flavivirus
GMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKK

SEQ ID NO: 644 - DNA, 38 bp, Artificial Sequence; identical to SEQ ID NO: 317
  primer

SEQ ID NO: 645 - DNA, 41 bp, Artificial Sequence; identical to SEQ ID NO: 318
  primer

SEQ ID NO: 646 - DNA, 42 bp, Artificial Sequence; identical to SEQ ID NO: 319
  primer

SEQ ID NO: 647 - DNA, 84 bp, Artificial Sequence; identical to SEQ ID NO: 320
  primer

SEQ ID NO: 648 - DNA, 20 bp, Artificial Sequence
  primer
tccggcgtagaggatcgaga

SEQ ID NO: 649 - DNA, 54 bp, Artificial Sequence
  primer
caattgaccttcaagcttcgaattgcccttacgtaacagagacagcacgttctg

SEQ ID NO: 650 - DNA, 57 bp, Artificial Sequence
  primer
aagcttgaaggtcaattggaattccctaggactagtatggaaaaattgcagttgaag

SEQ ID NO: 651 - DNA, 20 bp, Artificial Sequence
  primer
gcttaatgcgccgctacagg

SEQ ID NO: 652 - DNA, 40 bp, Artificial Sequence
  primer
gcggccgctcatggaaaaattgcagttgaagggaacaacc

SEQ ID NO: 653 - DNA, 32 bp, Artificial Sequence
  primer
ccgcggtttgccaatgctgcttccagacttgt

SEQ ID NO: 654 - DNA, 49 bp, Artificial Sequence
  primer
ccggcatgccatatggcacaagtaatcaacactaacagtctgtcgctgc

SEQ ID NO: 655 - DNA, 49 bp, Artificial Sequence
  primer
gcatgctcagcttattaagggtttgccaatgctgcttcccagacttgtg

SEQ ID NO: 656 - DNA, 27 bp, Artificial Sequence
  primer
tacgtgaattcagcagatatccagcac

SEQ ID NO: 657 - DNA, 1911 bp, Artificial Sequence
  STF2.EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgtaagggcaattcgaagcttgaaggtcaattggaattccctaggactagtatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 658 - protein, 637 aa, Artificial Sequence
  STF2.EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRKGNSKLEGQLEFPRTSMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 659 - protein, 10 aa, Artificial Sequence
  Linker
GAPVDPASPW

SEQ ID NO: 660 - DNA, 1218 bp, Artificial Sequence
  West Nile virus envelope protein
ttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggaccaactactgtggagtcgcacggaaactactccacacaggttggagccactcaggcagggagattcagcatcactcctgcagcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 661 - protein, 506 aa, S. muenchen; identical to SEQ ID NO: 504

SEQ ID NO: 662 - DNA, 1521 bp, S. muenchen
atggcacaagtcattaatacaaacagcctgtcgctgttgacccagaataacctgaacaaatcccagtccgctctgggcaccgctatcgagcgtctgtcttccggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacggtactaactcccagtctgaccttgactctatccaggctgaaatcacccagcgtctgaacgaaatcgaccgtgtatccggtcagactcagttcaacggcgtgaaagtcctggcgcaggacaacaccctgaccatccaggttggtgccaacgacggtgaaactattgatattgatttaaaagaaattagctctaaaacactgggacttgataagcttaatgtccaggatgcctacaccccgaaagaaactgctgtaaccgttgataaaactacctataaaaatggtacagatactattacagcccagagcaatactgatatccaaactgcaattggcggtggtgcaacgggggttactggggctgatatcaaatttaaagatggtcaatactatttagatgttaaaggcggtgcttctgctggtgtttataaagccacttatgatgaaactacaaagaaagttaatattgatacgactgataaaactccgttagcaactgcggaagctacagctattcggggaacggccactataacccacaaccaaattgctgaagtaacaaaagagggtgttgatacgaccacagttgcggctcaacttgctgctgcaggggttactggtgccgataaggacaatactagccttgtaaaactatcgtttgaggataaaaacggtaaggttattgatggtggctatgcagtgaaaatgggcgacgatttctatgccgctacatatgatgagaaaacaggtacaattactgctaaaacaaccacttatacagatggtgctggcgttgctcaaactggagctgtgaaatttggtggcgcaaatggtaaatctgaagttgttactgctaccgatggtaaaacttacttagcaagcgaccttgacaaacataacttcagaacaggcggtgagcttaaagaggttaatacagataagactgaaaacccactgcagaaaattgatgctgccttggcacaggttgatacacttcgttctgacctgggtgcggtacagaaccgtttcaactccgctatcaccaacctgggcaataccgtaaataacctgtcttctgcccgtagccgtatcgaagattccgactacgcgaccgaagtctccaacatgtctcgcgcgcagattctgcagcaggccggtacctccgttctggcgcaggctaaccaggttccgcaaaacgtcctctctttactgcgttaa

SEQ ID NO: 663 - protein, 12 aa, Artificial Sequence
  Linker
EFSRYPAQWRPL

SEQ ID NO: 664 - DNA, 36 bp, Artificial Sequence; identical to SEQ ID NO: 525
  Linker

SEQ ID NO: 665 - protein, 45 aa, Artificial Sequence; identical to SEQ ID NO: 526
  Linker

SEQ ID NO: 666 - DNA, 135 bp, Artificial Sequence; identical to SEQ ID NO: 527
  Linker

SEQ ID NO: 667 - protein, 192 aa, Artificial Sequence
  Hepatitis C E1
YQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDA

SEQ ID NO: 668 - protein, 363 aa, Artificial Sequence
  Hepatitis C E2
ETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEA

SEQ ID NO: 669 - DNA, 576 bp, Artificial Sequence
  Hepatitis C E1
taccaagtgcgcaactccacggggctctaccacgtcaccaatgattgccctaactcgagtattgtgtacgaggcggccgatgccatcctgcacactccggggtgcgtcccttgcgttcgcgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctgtgcgggtctgtctttcttgtcggccaactgtttaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcg

SEQ ID NO: 670 - DNA, 1089 bp, Artificial Sequence
  Hepatitis C E2
gaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacactatatttaaaatcaggatgtacgtgggaggggtcgagcacaggctggaagctgcctgcaactggacgcggggcgaacgttgcgatctggaagatagggacaggtccgagctcagcccgttactgctgaccactacacagtggcaggtcctcccgtgttccttcacaaccctgccagccttgtccaccggcctcatccacctccaccagaacattgtggacgtgcagtacttgtacggggtggggtcaagcatcgcgtcctgggccattaagtgggagtacgtcgtcctcctgttccttctgcttgcagacgcgcgcgtctgctcctgcttgtggatgatgctactcatatcccaagcggaagcg

SEQ ID NO: 671 - protein, 595 aa, E. coli
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGSGTIANKAATISDLTAAKMDAATNTITTTNNALTASKALDQLKDGDTVTIKADAAQTATVYTYNASAGNFSFSNVSNNTSAKAGDVAASLLPPAGQTASGVYKAASGEVNFDVDANGKITIGGQKAYLTSDGNLTTNDAGGATAATLDGLFKKAGDGQSIGFKKTASVTMGGTTYNFKTGADADAATANAGVSFTDTASKETVLNKVATAKQGKAVAADGDTSATITYKSGVQTYQAVFAAGDGTASAKYADKADVSNATATYTDADGEMTTIGSYTTKYSIDANNGKVTVDSGTGTGKYAPKVGAEVYVSANGTLTTDATSEGTVTKDPLKALDEAISSIDKFRSSLGAIQNRLDSAVTNLNNTTTNLSEAQSRIQDADYATEVSNMSKAQIIQQAGNSVLAKANQVPQQVLSLLQG

SEQ ID NO: 672 - DNA, 1788 bp, E. coli
atggcacaagtcattaataccaacagcctctcgctgatcactcaaaataatatcaacaagaaccagtctgcgctgtcgagttctatcgagcgtctgtcttctggcttgcgtattaacagcgcgaaggatgacgcagcgggtcaggcgattgctaaccgtttcacctctaacattaaaggcctgactcaggcggcccgtaacgccaacgacggtatctccgttgcgcagaccaccgaaggcgcgctgtccgaaatcaacaacaacttacagcgtatccgtgaactgacggttcaggcttctaccgggactaactccgattcggatctggactccattcaggacgaaatcaaatcccgtctggacgaaattgaccgcgtatctggccagacccagttcaacggcgtgaacgtactggcgaaagacggttcaatgaaaattcaggttggtgcgaatgacggccagactatcacgattgatctgaagaaaattgactcagatacgctggggctgaatggttttaacgtgaatggttccggtacgatagccaataaagcggcgaccattagcgacctgacagcagcgaaaatggatgctgcaactaatactataactacaacaaataatgcgctgactgcatcaaaggcgcttgatcaactgaaagatggtgacactgttactatcaaagcagatgctgctcaaactgccacggtttatacatacaatgcatcagctggtaacttctcattcagtaatgtatcgaataatacttcagcaaaagcaggtgatgtagcagctagccttctcccgccggctgggcaaactgctagtggtgtttataaagcagcaagcggtgaagtgaactttgatgttgatgcgaatggtaaaatcacaatcggaggacagaaagcatatttaactagtgatggtaacttaactacaaacgatgctggtggtgcgactgcggctacgcttgatggtttattcaagaaagctggtgatggtcaatcaatcgggtttaagaagactgcatcagtcacgatggggggaacaacttataactttaaaacgggtgctgatgctgatgctgcaactgctaacgcaggggtatcgttcactgatacagctagcaaagaaaccgttttaaataaagtggctacagctaaacaaggcaaagcagttgcagctgacggtgatacatccgcaacaattacctataaatctggcgttcagacgtatcaggctgtatttgccgcaggtgacggtactgctagcgcaaaatatgccgataaagctgacgtttctaatgcaacagcaacatacactgatgctgatggtgaaatgactacaattggttcatacaccacgaagtattcaatcgatgctaacaacggcaaggtaactgttgattctggaactggtacgggtaaatatgcgccgaaagtaggggctgaagtatatgttagtgctaatggtactttaacaacagatgcaactagcgaaggcacagtaacaaaagatccactgaaagctctggatgaagctatcagctccatcgacaaattccgttcttccctgggtgctatccagaaccgtctggattccgcagtcaccaacctgaacaacaccactaccaacctgtccgaagcgcagtcccgtattcaggacgccgactatgcgaccgaagtgtccaacatgtcgaaagcgcagatcattcagcaggccggtaactccgtgctggcaaaagccaaccaggtaccgcagcaggttctgtctctgctgcagggttaa

SEQ ID NO: 673 - DNA, 1224 bp, Artificial Sequence; identical to SEQ ID NO: 636
  STF2delta.EIII+

SEQ ID NO: 674 - protein, 408 aa, Artificial Sequence; identical to SEQ ID NO: 637
  STF2delta.EIII+

SEQ ID NO: 675 - protein, 408 aa, Artificial Sequence
  STF2delta.EIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKPLIS

SEQ ID NO: 676 - DNA, 1227 bp, Artificial Sequence
  STF2delta.EIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattctctagatatccagcacagtggcggccgctcatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaacccttaataagctga

SEQ ID NO: 677 - DNA, 35 bp, Artificial Sequence
  Linker
gaattctctagatatccagcacagtggcggccgct

SEQ ID NO: 678 - protein, 12 aa, Artificial Sequence
  Linker
EFSRYPAQWRPL

SEQ ID NO: 679 - protein, 405 aa, Artificial Sequence
  pET/STF2delta.JEIII+
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 680 - DNA, 1215 bp, Artificial Sequence
  pET/STF2delta.JEIII+
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattcagcagatatccagcacagtggcggccgctcatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggcc

SEQ ID NO: 681 - DNA, 348 bp, Artificial Sequence
  JEIII+
atggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggcc

SEQ ID NO: 682 - protein, 116 aa, Artificial Sequence
  JEIII+
MDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 683 - protein, 389 aa, Artificial Sequence
  pET/STF2delta.Den1 EIII
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLKGMSYVMCTGSFKLEKEVAETQHGTVLVQVKYEGTDAPCKIPFSTQDEKGVTQNGRLITANPIVTDKEKPVNIEAEPPFGENYIVVGAGEKALKLSWFKK

SEQ ID NO: 684 - DNA, 1185 bp, Artificial Sequence
  pET/STF2delta.Den1 EIII
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattcagcagatatccagcacagtggcggccgctcaaaggaatgtcttacgtaatgtgcacaggcagtttcaagctggaaaaagaagttgccgaaacacagcatggcacggtactagtccaagtgaaatatgagggaacagacgcgccatgtaagataccattttccactcaagatgagaaaggggcgactcagaacggaagattgataaccgcaaatcctatcgtaaccgacaaggaaaagcccgtgaatattgaggcagagcctccgtttggggagtcgtatatcgtcgttggtgctggtgaaaaggctttaaagctcagttggttcaaaaaggggtcaagcattggtaaa

SEQ ID NO: 685 - protein, 389 aa, Artificial Sequence
  pET/STF2delta.Den2 EIII
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLKGMSYSMCTGKFKVVKEIAETQHGTIVIRVQYEGDGSPCKTPFEIMDLEKRHVLGRLTTVNPIVTEKDSPVNIEAEPPFGDSYIIIGVEPGQLKLDWFKK

SEQ ID NO: 686 - DNA, 1185 bp, Artificial Sequence
  pET/STF2delta.Den2 EIII
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattcagcagatatccagcacagtggcggccgctcaaaggtatgagctatagcatgtgtaccggtaaatttaaagttgttaaagaaattgcggaaacccagcatggtaccattgttattcgtgttcagtatgaaggtgatggtagcccgtgtaaaattccgtttgaaattatggatctggaaaaacgtcatgttctgggtcgtctgattaccgttaatccgattgttaccgaaaaagatagcccggttaatattgaagcggaaccgccgtttggtgatagctatattattattggtgttgaaccgggtcagctgaaactgaattggtttaaaaaaggtagcagcattggtcag

SEQ ID NO: 687 - protein, 389 aa, Artificial Sequence
  pET/STF2delta.Den3 EIII
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRK

SEQ ID NO: 688 - DNA, 1185 bp, Artificial Sequence
  pET/STF2delta.Den3 EIII
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattcagcagatatccagcacagtggcggccgctcaaaggaatgagttatgcaatgtgtttaaatacatttgtattaaaaaaagaagtaagtgaaacacaacatggaacaatattaataaaagtagaatataaaggagaagatgcaccatgtaaaataccatttagtacagaagatggacaaggaaaagcacataatggaagattaataacagcaaatccagtagtaacaaaaaaagaagaaccagtaaatatagaagcagaaccaccatttggagaaagtaatatagtaataggaataggagataaagcattaaaaataaattggtatagaaaaggaagtagtataggaaaa

SEQ ID NO: 689 - protein, 388 aa, Artificial Sequence
  pET/STF2delta.Den4 EIII
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVHGAPVDPASPWTENPLQKIDAALAQVDALRSDLGAVQNRFNSAITNLGNTVNNLSEARSRIEDSDYATEVSNMSRAQILQQAGTSVLAQANQVPQNVLSLLREFSRYPAQWRPLKGMSYTMCSGKFSIDKEMAETQHGTTVVKVKYEGAGAPCKVPIEIRDVNKEKVVGRIISPTPFAENTNSVTNIELERPLDSYIVIGVGDSALTLHWFRK

SEQ ID NO: 690 - DNA, 1185 bp, Artificial Sequence
  pET/STF2delta.Den4 EIII
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcatggagcgccggtggatcctgctagcccatggaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtgaattcagcagatatccagcacagtggcggccgctcaagggaatgtcatacacgatgtgtagtggtaaattctctatagacaaagagatggcagagacacaacacgggacaaccgtcgtgaaggttaagtatgaaggagctggcgcaccgtgcaaagtacccatcgaaattagggatgtaaacaaagagaaggtcgttgggcgtatcattagctcaaccccacttgcggaaaatactaattctgtaacgaacatagagttggaaccaccttttggtgatagctatatagttattggtgtgggcaatagtgccttaactctacattggtttagaaaaggatcctcgatcgggaaa

SEQ ID NO: 691 - protein, 27 aa, Artificial Sequence
  West Nile virus
LTSGHLKCRVKMEKLQLKGTTYGVCSK

SEQ ID NO: 692 - protein, 27 aa, Artificial Sequence
  Japanese encephalitis virus
LTSGHLKCRLKMDKLALKGTTYGMCTE

SEQ ID NO: 693 - protein, 27 aa, Artificial Sequence
  Dengue virus
IFAGHLKCRLKMDKLTLKGMSYVMCTG

SEQ ID NO: 694 - protein, 27 aa, Artificial Sequence
  Dengue virus
LFTGHLKCRLRMDKLQLKGMSYSMCTG

SEQ ID NO: 695 - protein, 27 aa, Artificial Sequence
  Dengue virus
IFAGHLKCRLKMDKLKLKGMSYAMCLN

SEQ ID NO: 696 - protein, 27 aa, Artificial Sequence
  Dengue virus
MFAGHLKCKVRMEKLRIKGMSYTMCSG

SEQ ID NO: 697 - protein, 27 aa, Artificial Sequence
  Flavivirus envelope protein
  VARIANT 1, 2, 3, 10, 11, 13, 16, 20, 21, 23, 24, 26, 27: Xaa = Any Amino Acid
XXXGHLKCRXXMXKLXLKGXXYXXCXX

SEQ ID NO: 698 - protein, 14 aa, Artificial Sequence
  Flavivirus envelope protein
GHLKCRMKLLKGYC

SEQ ID NO: 699 - protein, 100 aa, Artificial Sequence
  Dengue virus
KGMSYVMCTGSFKLEKEVAETQHGTVLVQVKYEGTDAPCKIPFSTQDEKGVTQNGRLITANPIVTDKEKPVNIEAEPPFGENYIVVGAGEKALKLSWFKK

SEQ ID NO: 700 - protein, 100 aa, Artificial Sequence
  Dengue virus
KGMSYSMCTGKFKVVKEIAETQHGTIVIRVQYEGDGSPCKTPFEIMDLEKRHVLGRLTTVNPIVTEKDSPVNIEAEPPFGDSYIIIGVEPGQLKLDWFKK

SEQ ID NO: 701 - protein, 100 aa, Artificial Sequence
  Dengue virus
KGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRK

SEQ ID NO: 702 - protein, 99 aa, Artificial Sequence
  Dengue virus
KGMSYTMCSGKFSIDKEMAETQHGTTVVKVKYEGAGAPCKVPIEIRDVNKEKVVGRIISPTPFAENTNSVTNIELERPLDSYIVIGVGDSALTLHWFRK

SEQ ID NO: 703 - protein, 20 aa, Artificial Sequence
  Flavivirus envelope protein
CRVKMEKLQLKGTTYGVCSK

SEQ ID NO: 704 - protein, 20 aa, Artificial Sequence
  Flavivirus envelope protein
SRVKMEKLQLKGTTYGVCSK

SEQ ID NO: 705 - protein, 20 aa, Artificial Sequence
  Flavivirus envelope protein
CRVKMEKLQLKGTTYGVSSK

SEQ ID NO: 706 - protein, 20 aa, Artificial Sequence
  Flavivirus envelope protein
SRVKMEKLQLKGTTYGVSSK

SEQ ID NO: 707 - protein, 20 aa, Artificial Sequence
  Flavivirus envelope protein
CRVKMEKLQLKGTTYGVCSK

SEQ ID NO: 708 - protein, 20 aa, Artificial Sequence
  Flavivirus envelope protein
ARVKMEKLQLKGTTYGVCSK

SEQ ID NO: 709 - protein, 20 aa, Artificial Sequence
  Flavivirus envelope protein
CAVKMEKLQLKGTTYGVCSK

SEQ ID NO: 710 - protein, 20 aa, Artificial Sequence
  Flavivirus envelope protein
CRAKMEKLQLKGTTYGVCSK

SEQ ID NO: 711 - protein, 20 aa, Artificial Sequence
  Flavivirus envelope protein
CRVAMEKLQLKGTTYGVCSK

SEQ ID NO: 712 - protein, 20 aa, Artificial Sequence
  Flavivirus envelope protein
CRVKAEKLQLKGTTYGVCSK

SEQ ID NO: 713 - protein, 20 aa, Artificial Sequence
  Flavivirus envelope protein
CRVKMAKLQLKGTTYGVCSK

SEQ ID NO: 714 - protein, 20 aa, Artificial Sequence
  Flavivirus envelope protein
CRVKMEALQLKGTTYGVCSK

SEQ ID NO: 715 - protein, 20 aa, Artificial Sequence
  Flavivirus envelope protein
CRVKMEKAQLKGTTYGVCSK

SEQ ID NO: 716 - protein, 20 aa, Artificial Sequence
  Flavivirus envelope protein
CRVKMEKLALKGTTYGVCSK

SEQ ID NO: 717 - protein, 20 aa, Artificial Sequence
  Flavivirus envelope protein
CRVKMEKLQAKGTTYGVCSK

SEQ ID NO: 718 - protein, 20 aa, Artificial Sequence
  Flavivirus envelope protein
CRVKMEKLQLAGTTYGVCSK

SEQ ID NO: 719 - protein, 20 aa, Artificial Sequence
  Flavivirus envelope protein
CRVKMEKLQLKATTYGVCSK

SEQ ID NO: 720 - protein, 20 aa, Artificial Sequence
  Flavivirus envelope protein
CRVKMEKLQLKGATYGVCSK

SEQ ID NO: 721 - protein, 20 aa, Artificial Sequence
  Flavivirus envelope protein
CRVKMEKLQLKGTAYGVCSK

SEQ ID NO: 722 - protein, 20 aa, Artificial Sequence
  Flavivirus envelope protein
CRVKMEKLQLKGTTAGVCSK

SEQ ID NO: 723 - protein, 20 aa, Artificial Sequence
  Flavivirus envelope protein
CRVKMEKLQLKGTTYAVCSK

SEQ ID NO: 724 - protein, 20 aa, Artificial Sequence
  Flavivirus envelope protein
CRVKMEKLQLKGTTYGACSK

SEQ ID NO: 725 - protein, 20 aa, Artificial Sequence
  Flavivirus envelope protein
CRVKMEKLQLKGTTYGVASK

SEQ ID NO: 726 - protein, 20 aa, Artificial Sequence
  Flavivirus envelope protein
CRVKMEKLQLKGTTYGVCAK

SEQ ID NO: 727 - protein, 20 aa, Artificial Sequence
  Flavivirus envelope protein
CRVKMEKLQLKGTTYGVCSA

SEQ ID NO: 728 - protein, 20 aa, Artificial Sequence
  Flavivirus envelope protein
CRVKMEKLQLKGTTYGVCSK

SEQ ID NO: 729 - protein, 20 aa, Artificial Sequence
  Flavivirus envelope protein
SNTVKLTSGHLKCRVKMEKL

SEQ ID NO: 730 - protein, 20 aa, Artificial Sequence
  Flavivirus envelope protein
NTVKLTSGHLKCRVKMEKLQ

SEQ ID NO: 731 - protein, 20 aa, Artificial Sequence
  Flavivirus envelope protein
TVKLTSGHLKCRVKMEKLQL

SEQ ID NO: 732 - protein, 20 aa, Artificial Sequence
  Flavivirus envelope protein
VKLTSGHLKCRVKMEKLQLK

SEQ ID NO: 733 - protein, 20 aa, Artificial Sequence
  Flavivirus envelope protein
KLTSGHLKCRVKMEKLQLKG

SEQ ID NO: 734 - protein, 20 aa, Artificial Sequence
  Flavivirus envelope protein
LTSGHLKCRVKMEKLQLKGT

SEQ ID NO: 735 - protein, 20 aa, Artificial Sequence
  Flavivirus envelope protein
TSGHLKCRVKMEKLQLKGTT

SEQ ID NO: 736 - protein, 20 aa, Artificial Sequence
  Flavivirus envelope protein
SGHLKCRVKMEKLQLKGTTY

SEQ ID NO: 737 - protein, 20 aa, Artificial Sequence
  Flavivirus envelope protein
GHLKCRVKMEKLQLKGTTYG

SEQ ID NO: 738 - protein, 20 aa, Artificial Sequence
  Flavivirus envelope protein
HLKCRVKMEKLQLKGTTYGV

SEQ ID NO: 739 - protein, 20 aa, Artificial Sequence
  Flavivirus envelope protein
LKCRVKMEKLQLKGTTYGVC

SEQ ID NO: 740 - protein, 20 aa, Artificial Sequence
  Flavivirus envelope protein
KCRVKMEKLQLKGTTYGVCS

SEQ ID NO: 741 - protein, 20 aa, Artificial Sequence
  Flavivirus envelope protein
CRVKMEKLQLKGTTYGVCSK

SEQ ID NO: 742 - protein, 20 aa, Artificial Sequence
  Flavivirus envelope protein
RVKMEKLQLKGTTYGVCSKA

SEQ ID NO: 743 - protein, 20 aa, Artificial Sequence
  Flavivirus envelope protein
VKMEKLQLKGTTYGVCSKAF

SEQ ID NO: 744 - protein, 20 aa, Artificial Sequence
  Flavivirus envelope protein
KMEKLQLKGTTYGVCSKAFK

SEQ ID NO: 745 - protein, 20 aa, Artificial Sequence
  Flavivirus envelope protein
MEKLQLKGTTYGVCSKAFKF

SEQ ID NO: 746 - protein, 20 aa, Artificial Sequence
  Flavivirus envelope protein
EKLQLKGTTYGVCSKAFKFL

SEQ ID NO: 747 - protein, 20 aa, Artificial Sequence
  Flavivirus envelope protein
KLQLKGTTYGVCSKAFKFLG

SEQ ID NO: 748 - protein, 20 aa, Artificial Sequence
  Flavivirus envelope protein
LQLKGTTYGVCSKAFKFLGT

SEQ ID NO: 749 - protein, 20 aa, Artificial Sequence
  Flavivirus envelope protein
QLKGTTYGVCSKAFKFLGTP

SEQ ID NO: 750 - protein, 20 aa, Artificial Sequence
  Flavivirus envelope protein
LKGTTYGVCSKAFKFLGTPA

SEQ ID NO: 751 - protein, 20 aa, Artificial Sequence
  Flavivirus envelope protein
KGTTYGVCSKAFKFLGTPAD

SEQ ID NO: 752 - protein, 20 aa, Artificial Sequence
  Flavivirus envelope protein
GTTYGVCSKAFKFLGTPADT

SEQ ID NO: 753 - protein, 20 aa, Artificial Sequence
  Flavivirus envelope protein
TTYGVCSKAFKFLGTPADTG

SEQ ID NO: 754 - protein, 20 aa, Artificial Sequence
  Flavivirus envelope protein
TYGVCSKAFKFLGTPADTGH

SEQ ID NO: 755 - DNA, 2760 bp, Artificial Sequence
  STF2.OVA
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtctcgagggctccatcggcgcagcaagcatggaattttgttttgatgtattcaaggagctcaaagtccaccatgccaatgagaacatcttctactgccccattgccatcatgtcagctctagccatggtatacctgggtgcaaaagacagcaccaggacacaaataaataaggttgttcgctttgataaacttccaggattcggagacagtattgaagctcagtgtggcacatctgtaaacgttcactcttcacttagagacatcctcaaccaaatcaccaaaccaaatgatgtttattcgttcagccttgccagtagactttatgctgaagagagatacccaatcctgccagaatacttgcagtgtgtgaaggaactgtatagaggaggcttggaacctatcaactttcaaacagctgcagatcaagccagagagctcatcaattcctgggtagaaagtcagacaaatggaattatcagaaatgtccttcagccaagctccgtggattctcaaactgcaatggttctggttaatgccattgtcttcaaaggactgtgggagaaagcatttaaggatgaagacacacaagcaatgcctttcagagtgactgagcaagaaagcaaacctgtgcagatgatgtaccagattggtttatttagagtggcatcaatggcttctgagaaaatgaagatcctggagcttccatttgccagtgggacaatgagcatgttggtgctgttgcctgatgaagtctcaggccttgagcagcttgagagtataatcaactttgaaaaactgactgaatggaccagttctaatgttatggaagagaggaagatcaaagtgtacttacctcgcatgaagatggaggaaaaatacaacctcacatctgtcttaatggctatgggcattactgacgtgtttagctcttcagccaatctgtctggcatctcctcagcagagagcctgaagatatctcaagctgtccatgcagcacatgcagaaatcaatgaagcaggcagagaggtggtagggtcagcagaggctggagtggatgctgcaagcgtctctgaagaatttagggctgaccatccattcctcttctgtatcaagcacatcgcaaccaacgccgttctcttctttggcagatgtgtttccccttcgaagcttgaaggtaagcctatccctaaccctctcctcggtctcgattctacgcgtaccggtcatcatcaccatcaccat

SEQ ID NO: 756 - protein, 920 aa, Artificial Sequence
  STF2.OVA
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRLEGSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSPSKLEGKPIPNPLLGLDSTRTGHHHHHH

SEQ ID NO: 757 - protein, 385 aa, Artificial Sequence
  OVA
GSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 758 - DNA, 1156 bp, Artificial Sequence
  OVA
gggctccatcggcgcagcaagcatggaattttgttttgatgtattcaaggagctcaaagtccaccatgccaatgagaacatcttctactgccccattgccatcatgtcagctctagccatggtatacctgggtgcaaaagacagcaccaggacacaaataaataaggttgttcgctttgataaacttccaggattcggagacagtattgaagctcagtgtggcacatctgtaaacgttcactcttcacttagagacatcctcaaccaaatcaccaaaccaaatgatgtttattcgttcagccttgccagtagactttatgctgaagagagatacccaatcctgccagaatacttgcagtgtgtgaaggaactgtatagaggaggcttggaacctatcaactttcaaacagctgcagatcaagccagagagctcatcaattcctgggtagaaagtcagacaaatggaattatcagaaatgtccttcagccaagctccgtggattctcaaactgcaatggttctggttaatgccattgtcttcaaaggactgtgggagaaagcatttaaggatgaagacacacaagcaatgcctttcagagtgactgagcaagaaagcaaacctgtgcagatgatgtaccagattggtttatttagagtggcatcaatggcttctgagaaaatgaagatcctggagcttccatttgccagtgggacaatgagcatgttggtgctgttgcctgatgaagtctcaggccttgagcagcttgagagtataatcaactttgaaaaactgactgaatggaccagttctaatgttatggaagagaggaagatcaaagtgtacttacctcgcatgaagatggaggaaaaatacaacctcacatctgtcttaatggctatgggcattactgacgtgtttagctcttcagccaatctgtctggcatctcctcagcagagagcctgaagatatctcaagctgtccatgcagcacatgcagaaatcaatgaagcaggcagagaggtggtagggtcagcagaggctggagtggatgctgcaagcgtctctgaagaatttagggctgaccatccattcctcttctgtatcaagcacatcgcaaccaacgccgttctcttctttggcagatgtgtttcccct

SEQ ID NO: 759 - DNA, 18 bp, Artificial Sequence
  Primer
catctcagtgcaactaaa

SEQ ID NO: 760 - DNA, 18 bp, Artificial Sequence
  Primer
tagaaggcacagtcgagg

SEQ ID NO: 761 - DNA, 2736 bp, Artificial Sequence
  STF2.E
atggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaaccacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattttgcagcaggccggtacttccgttctggcgcaggctaaccaggtcccgcagaacgtgctgtctctgttacgtttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggaccaactactgtggagtcgcacggaaactactccacacaggttggagccactcaggcagggagattcagcatcactcctgcagcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaa

SEQ ID NO: 762 - protein, 912 aa, Artificial Sequence
  STF2.E
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 763 - protein, 495 aa, Artificial Sequence
  Dengue 1
MRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIAQYENLKYSVIVTVHTGDQHQVGNETTEHGTTATITPQAPTSEIQLTDYGTLTLDCSPRTGLDFNEMVLLTMKKKSWLVHKQWFLDLPLPWTSGALTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSVMCIAVGMVTLYLGVMVQA

SEQ ID NO: 764 - DNA, 1485 bp, Artificial Sequence
  Dengue 1
atgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagctcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaaaagaaatcatggcttgtccacaaacagtggtttctagacttaccactgccttggacctctggggctttaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcggtgatgtgcatcgcagttggcatggtcacactgtacctaggagtcatggttcaggca

SEQ ID NO: 765 - protein, 495 aa, Artificial Sequence
  Dengue 2
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSTTEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 766 - DNA, 1485 bp, Artificial Sequence
  Dengue 2
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccaccacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggcc

SEQ ID NO: 767 - protein, 493 aa, Artificial Sequence
  Dengue 3
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQA

SEQ ID NO: 768 - DNA, 1479 bp, Artificial Sequence
  Dengue 3
atgagatgcgtgggagtaggaaacagagattttgtggaaggtctgtcgggagctacgtgggttgatgtggtgctcgagcacggagggtgtgtgaccaccatggctaagaacaagcctacgctggacatagagctccagaagaccgaggccacccaactggcgaccctaagaaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgttgaagctatcttgcctgaatatggaacccttgggctagaatgttcaccacggacaggtttggatttcaacgaaatgattttattgacaatgaagaacaaagcatggatggtacataggcaatggttctttgacctacccctaccatggacatcaggagctacaacagagacaccaacttggaacaggaaagagctccttgtgacattcaagaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctctgaaacgcagcatgggacaatactcatcaaggttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgattgggattggagacaaagccttgaaaattaactggtacaagaagggaagctcgattggaaagatgttcgaggctactgccagaggtgcaaggcgcatggccatcttgggagacacagcctgggattttggttcagtgggtggtgttctgaattcattagggaaaatggtacaccaaatattcggaagtgcttacacagccctgtttagtggagtctcatggataatgaaaattggaataggtgtcctcttaacctggatagggttgaattcaaaaaacacttccatgtcattttcatgcattgcgataggaattattacactctatctgggagccgtggtacaagct

SEQ ID NO: 769 - protein, 491 aa, Artificial Sequence
  Dengue 4
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVRIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCEVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGF

SEQ ID NO: 770 - DNA, 1473 bp, Artificial Sequence
  Dengue 4
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccgaattgagaaccttgaatacacagtggtggtaacagtccacaatggagacacccatgcagtaggaaatgacacatccaatcatggagttacagccatgataacccccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcgaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggattgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttc

SEQ ID NO: 771 - protein, 20 aa, Artificial Sequence
  West Nile virus
LTSGHLKCRVKMEKLQLKGT

SEQ ID NO: 772 - protein, 20 aa, Artificial Sequence
  West Nile virus
LTSGHLKCRVKMEKLQLKGT

SEQ ID NO: 773 - DNA, 1217 bp, Artificial Sequence
  Japanese encephalitis
tttaattgtctgggaatgggcaatcgtgacttcatagaaggagccagtggagccgcttgggtgacttggtgctagaaggagacagctgcttgacaatcatggcaaacgacaaaccaacattggacgtccgcatgattaacatcgaagctagccaacttgctgaggtcagaagttactgctatcatgcttcagtcactgacatctcgacggtggctcggtgccccacgactggagaagcccacaacgagaagcgagctgatagtagctatgtgtgcaaacaaggcttcactgaccgtgggtggggcaacggatgtggatttttcgggaagggaagcattgacacatgtgcaaaattctcctgcaccagtaaagcgattgggagaacaatccagccagaaaacatcaaatacaaagttggcatttttgtgcatggaaccaccacttcggaaaaccatgggaattattcagcgcaagttggggcgtcccaggcggcaaagtttacagtaacacccaatgctccttcggtagccctcaaacttggtgactacggagaagtcacactggactgtgagccaaggagtggactgaacactgaagcgttttacgtcatgaccgtggggtcaaagtcatttctggtccatagggagtggtttcatgacctcgctctcccctggacgtccccttcgagcacagcgtggagaaacagagaactcctcatggaatttgaaggggcgcacgccacaaaacagtccgttgttgctcttgggtcacaggaaggaggcctccatcatgcgttggcaggagccatcgtggtggagtactcaagctcagtgatgttaacatcaggccacctgaaatgtaggctgaaaatggacaaactggctctgaaaggcacaacctatggcatgtgtacagaaaaattctcgttcgcgaaaaatccggtggacactggtcacggaacagttgtcattgaactctcctactctgggagtgatggcccctgcaaaattccgattgtttccgttgcgagcctcaatgacatgacccccgttgggcggctggtgacagtgaaccccttcgtcgcgacttccagtgccaactcaaaggtgctggtcgagatggaaccccccttcggagactcctacatcgtagttggaaggggagacaagcagatcaaccaccattggcacaaagctggaagcacgctgggcaaggcc

SEQ ID NO: 774 - protein, 406 aa, Artificial Sequence
  Japanese encephalitis
FNCLGMGNRDFIEGASGAAWVDLVLEGDSCLTIMANDKPTLDVRMINIEASQLAEVRSYCYHASVTDISTVARCPTTGEAHNEKRADSSYVCKQGFTDRGWGNGCGFFGKGSIDTCAKFSCTSKAIGRTIQPENIKYKVGIFVHGTTTSENHGNYSAQVGASQAAKFTVTPNAPSVALKLGDYGEVTLDCEPRSGLNTEAFYVMTVGSKSFLVHREWFHDLALPWTSPSSTAWRNRELLMEFEGAHATKQSVVALGSQEGGLHHALAGAIVVEYSSSVMLTSGHLKCRLKMDKLALKGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 775 - protein, 5 aa, Artificial Sequence
  West Nile virus
MEKLQ

SEQ ID NO: 776 - protein, 6 aa, Artificial Sequence
  West Nile virus
MDKLAL

SEQ ID NO: 777 - protein, 496 aa, Artificial Sequence
  Tick-borne encephalitis
SRCTHLENRDFVTGTQGTTRVTLVLELGGCVTITAEGKPSMDVWLDSIYQENPAKTREYCLHAKLSDTKVAARCPTMGPATLTEEHQSGTVCKRDQSDRGWGNHCGLFGKGSIVTCVKVACEAKKKAIGHVYDANKIVYTVKVEPHTGDYVAANETHSGRKTASFTVSSEKTILTMGDYGDVPLLCRVASGVDLAQTVILELDKTLEHLPTAWQVHRDWFNDLALPWKHEGAQQWNNAERLVEFGAPHAVKMDVYNLGDQTGVLLKSLAGVPVAHIDGTKYHLKSGHVTCEVGLEKLKMKGLTYTMCDKTKFAWKRTPTDSGHDTVVMEVTFSGTKPCRIPVRAVAHGSPDVNVAMLITPNPTIENNGGGFIEMQLPPGDNIIYVGELSHQWFQKGSSIGRVFQKTRKGIERLTVIGEHAWDFGSTGGFLTSVGKALHTVLGGAFNSIFGGVGFLPKLLLGVALAWLGLNMRNPTMSMSFLLAGGLVLAMTLGVGA

SEQ ID NO: 778 - DNA, 1488 bp, Artificial Sequence
  Tick-borne encephalitis
tcgcggtgcacacatttggagaacagggactttgtcactggtactcagggaaccacgagagtgactctggtgttggagctggggggatgtgtcacgatcactgctgaggggaagccctcaatggatgtgtggctcgattccatctatcaggagaaccctgccaagacacgcgagtactgtctgcatgccaagctgtcggacaccaaagttgcggccagatgcccaacaatggggcctgccactctgactgaggagcatcagagtggtacggtgtgcaagagagaccagagtgaccgaggctggggcaatcactgcggattgtttggaaagggcagtattgtgacctgtgtcaaggtggcttgtgaggcaaagaagaaggccattggacatgtgtatgatgccaacaagatcgtgtacaccgttaaggttgagccacacacgggggactatgttgccgccaatgaaacccacagtgggaggaagacggcatccttcacggtctcctcagaaaagaccatcttgactatgggggactatggagatgtgcccttgttgtgcagagtcgccagtggcgttgacttggctcagactgtcattcttgagcttgacaagactctggaacaccttccaacagcctggcaggtccatcgtgactggttcaatgatctggctctaccgtggaaacacgaaggagcgcaacaatggaacaatgctgagcgactggttgaatttggagctccgcatgccgttaaaatggacgtgtataaccttggagatcaaactggggtgttgttgaagtcacttgctggggttcctgtggcgcacattgatggaacaaagtaccacctaaaaagcggccatgtaacatgcgaggttggactagaaaagctcaaaatgaagggtctcacatacacaatgtgtgacaaaacgaagttcgcatggaagcggactccaacagacagcggacatgacacagtggtcatggaggtcacgttctctggaacaaaaccttgcaggatcccagtgcgggcagtggcacacggctctccagatgtaaatgtggccatgctgataacaccaaaccccaccattgagaacaatggaggtggcttcatagagatgcagctacccccaggggataacatcatctatgttggggaactaagccatcagtggttccagaaggggagcagcatcggaagggtgtttcaaaagaccaggaagggcatcgagagactgacagtgataggagaacacgcctgggacttcggttccactggaggtttcttgacttcggtaggcaaagcgctgcacacagtcctcggcggagccttcaacagcatctttgggggagtggggtttctgcccaagctcctgttgggtgtggccttagcctggttgggcctgaacatgaggaaccccaccatgtccatgagtttcctcttggctgggggactggtcctggctatgacacttggagtgggtgct

SEQ ID NO: 779 - protein, 110 aa, Artificial Sequence
  Domain III of West Nile virus
LKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGK

SEQ ID NO: 780 - protein, 110 aa, Artificial Sequence
  Domain III of Japanese encephalitis virus
KGTTYGMCTEKFSFAKNPVDTGHGTVVIELSYSGSDGPCKIPIVSVASLNDMTPVGRLVTVNPFVATSSANSKVLVEMEPPFGDSYIVVGRGDKQINHHWHKAGSTLGKA

SEQ ID NO: 781 - DNA, 345 bp, Artificial Sequence; identical to SEQ ID NO: 614
  West Nile EIII+

SEQ ID NO: 782 - protein, 23 aa, Artificial Sequence
  P. aeruginosa
MNNVLKFSALALAAVLATGCSSH

SEQ ID NO: 783 - DNA, 72 bp, Artificial Sequence
  P. aeruginosa
atgaaagctactaaactggtactgggcgcggtaatcctgggttctactctgctggcaggttgctccagcaac

SEQ ID NO: 784 - protein, 24 aa, Artificial Sequence
  E. coli
MKATKLVLGAVILGSTLLAGCSSN

SEQ ID NO: 785 - DNA, 72 bp, Artificial Sequence; identical to SEQ ID NO: 783
  E. coli

SEQ ID NO: 786 - protein, 11 aa, Artificial Sequence
  Linker
HGAPVDPASPW

SEQ ID NO: 787 - protein, 585 aa, B/Victoria/2/87 HA
MKAIIVLLMVVTSNADRICTGITSSNSPHVVKTATQGEVNVTGVIPLTTTPTKSHFANLKGTKTRGKLCPKCLNCTDLDVALGRPKCTGTIPSAKASILHEVKPVTSGCFPIMHDRTKIRQLPNLLRGYEHIRLSTHNVINAETAPGGPYKVGTSGSCPNVTNGNGFFATMAWAVPKNDNNKTATNPLTVEVPYICTEGEDQITVWGFHSDNEAQMVKLYGDSKPQKFTSSANGVTTHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKEKGFFGAIAGFLEGGWEGMIAGWHGYTSHGAHGVAVAADLKSTQEAINKITKNLNSLSELEVKNLQRLSGAMDELHNKILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 788 - protein, 535 aa, Artificial Sequence
  Cross-reactive mutant (CRM) of diphtheria toxin including, CRM197
GADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 789 - protein, 164 aa, Artificial Sequence
  Coat protein of Tobacco mosaic virus (TMV)
MMAYSIPTPSQLVYFTENYADYIPFVNRLINARSNSFQTQSGRDELREILIKSQVSVVSPISRFPAEPAYYIYLRDPSISTVYTALLQSTDTRNRVIEVENSTNVTTAEQLNAVRRTDDASTAIHNNLEQLLSLLTNGTGVFNRTSFESASGLTWLVTTTPRTA

SEQ ID NO: 790 - protein, 221 aa, Artificial Sequence
  Coat protein of alfalfa mosaic virus (AMV)
MSSSQKKAGGKAGKPTKRSQNYAALRKAQLPKPPALKVPVAKPTNTILPQTGCVWQSLGTPLSLSSSNGLGARFLYSFLKDFAAPRILEEDLIFRMVFSITPSHAGSFCLTDDVTTEDGRAVAHGNPMQEFPHGAFHANEKFGFELVFTAPTHAGMQNQNFKHSYAVALCLDFDALPEGSRNPSYRFNEVWVERKAFPRAGPLRSLITVGLFDDADDLDRQ

SEQ ID NO: 791 - protein, 237 aa, Artificial Sequence
  Coat protein of Potato virus X
MTTPANTTQATGSTTSTTTKTAGATPATTSGLFTIPDGEFFSTARAIVASNAVATNEDLSKIEAIWKDMKVPTDTMAQAAWDLVRHCADVGSSAQTEMIDTGPYSNGISRARLAAAIKEVCTLRQFCMKYAPVVWNWMLTNNSPPANWQAQGFKPEHKFAAFDFFNGVTNPAAIMPKEGLIRPPSEAEMNAAQTAAFVKITKARAQSNDFASLDAAVTRGRITGTTTAEAVVTLPPP

SEQ ID NO: 792 - protein, 395 aa, Artificial Sequence
  class I outer membrane protein of Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 793 - protein, 347 aa, Artificial Sequence
  Major fimbrial subunit protein type I (Fimbrillin)
MVLKTSNSNRAFGVGDDESKVAKLTVMVYNGEQQEAIKSAENATKVEDIKCSAGQRTLVVMANTGAMELVGKTLAEVKALTTELTAENQEAAGLIMTAEPKTIVLKAGKNYIGYSGTGEGNHIENDPLKIKRVHARMAFTEIKVQMSAAYDNIYTFVPEKIYGLIAKKQSNLFGATLVNADANYLTGSLTTFNGAYTPANYANVPWLSRNYVAPAADAPQGFYVLENDYSANGGTIHPTILCVYGKLQKNGADLAGADLAAAQAANWVDAEGKTYYPVLVNFNSNNYTYDSNYTPKNKIERNHKYDIKLTITGPGTNNPENPITESAHLNVQCTVAEWVLVGQNATW

SEQ ID NO: 794 - protein, 428 aa, Artificial Sequence
  Mycoplasma fermentans macrophage activating lipopeptide (MALP-2)
MKKSKKILLGLSPIAAVLPAVAVSCGNNDESNISFKEKDISKYTTTNANGKQVVKNAELLKLKPVLITDEGKIDDKSFNQSAFEALKAINKQTGIEINSVEPSSNFESAYNSALSAGHKIWVLNGFKHQQSIKQYIDAHREELERNQIKIIGIDFDIETEYKWFYSLQFNIKESAFTTGYAIASWLSEQDESKRVVASFGVGAFPGVTTFNEGFAKGILYYNQKHKSSKIYHTSPVKLDSGFTAGEKMNTVINNVLSSTPADVKYNPHVILSVAGPATFETVRLANKGQYVIGVDSDQGMIQDKDRILTSVLKHIKQAVYETLLDLILEKEEGYKPYVVKDKKADKKWSHFGTQKEKWIGVAENHFSNTEEQAKINNKIKEAIKMFKELPEDFVKYINSDKALKDGNKIDNVSERLEAIISAINKAAK

SEQ ID NO: 795 - protein, 143 aa, Artificial Sequence
  p19 protein of Mycobacterium tuberculosis
ATTLPVQRHPRSLFPEFSELFAAFPSFAGLRPTFDTRLMRLEDEMKEGRYEVRAELPGVDPDKDVDIMVRDGQLTIKAERTEQKDFDGRSEFAYGSFVRTVSLPVGADEDDIKATYDKGILTVSVAVSEGKPTEKHIQIRSTN

SEQ ID NO: 796 - protein, 19 aa, Artificial Sequence
  muturational cleavage site
NVPEKQTRGIFGAIAGFIE

SEQ ID NO: 797 - protein, 19 aa, Artificial Sequence
  muturational cleavage site
NIPSIQSRGLFGAIAGFIE

SEQ ID NO: 798 - protein, 19 aa, Artificial Sequence
  muturational cleavage site
PAKLLKERGFFGAIAGFLE

SEQ ID NO: 799 - protein, 19 aa, Artificial Sequence
  muturational cleavage site
RERRRKKRGLFGAIAGFIE

SEQ ID NO: 800 - protein, 19 aa, Artificial Sequence
  muturational cleavage site
NVPEKQTRGIFGAIAGFIE

SEQ ID NO: 801 - protein, 19 aa, Artificial Sequence
  muturational cleavage site
NVPQIESRGLFGAIAGFIE

SEQ ID NO: 802 - protein, 19 aa, Artificial Sequence
  muturational cleavage site
NIPSIQSRGLFGAIAGFIE

SEQ ID NO: 803 - protein, 12 aa, Artificial Sequence
  muturational cleavage site
RGLFGAIAGFIE

SEQ ID NO: 804 - protein, 19 aa, Artificial Sequence
  muturational cleavage site
PAKLLKERGFFGAIAGFLE

SEQ ID NO: 805 - protein, 12 aa, Artificial Sequence
  muturational cleavage site
RGFFGAIAGFLE

SEQ ID NO: 806 - protein, 24 aa, Artificial Sequence
  muturational cleavage site
SLLTEVETPIRNEWGSRSNDSSDP

SEQ ID NO: 807 - protein, 29 aa, Artificial Sequence
  muturational cleavage site
GSGAGSLLTEVETPTRNEWECRCSDSSDP

SEQ ID NO: 808 - protein, 29 aa, Artificial Sequence
  muturational cleavage site
GSGAGSLLTEVETLTRNGWGCRCSDSSDP

SEQ ID NO: 809 - protein, 20 aa, Artificial Sequence
  muturational cleavage site
LTSGHLKCRVKMEKLQLKGT

SEQ ID NO: 810 - protein, 27 aa, Artificial Sequence
  muturational cleavage site
EAEPPFGDSYIIIGVEPGQLKLNWFKK

SEQ ID NO: 811 - protein, 24 aa, Artificial Sequence
  muturational cleavage site
SLLTEVETPIRNEWGSRSNDSSDP

SEQ ID NO: 812 - protein, 494 aa, S. typhimurium flagellin (P06179)
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSARSRIEDSDYATEVSNMSRAQILQQAGTSVLAQANQVPQNVLSLLR

SEQ ID NO: 813 - protein, 504 aa, Salmonella muenchen flagellin (P06177)
AQVINTNSLSLLTQNNLNKSQSALGTAIERLSSGLRINSAKDDAAGQAIANRFTANIKGLTQASRNANDGISIAQTTEGALNEINNNLQRVRELAVQSANGTNSQSDLDSIQAEITQRLNEIDRVSGQTQFNGVKVLAQDNTLTIQVGANDGETIDIDLKEISSKTLGLDKLNVQDAYTPKETAVTVDKTTYKNGTDTITAQSNTDIQTAIGGGATGVTGADIKFKDGQYYLDVKGGASAGVYKATYDETTKKVNIDTTDKTPLATAEATAIRGTATITHNQIAEVTKEGVDTTTVAAQLAAAGVTGADKDNTSLVKLSFEDKNGKVIDGGYAVKMGDDFYAATYDEKQVQLLLNNHYTDGAGVLQTGAVKFGGANGKSEVVTATVGKTYLASDLDKHNFRTGGELKEVNTDKTENPLQKIDAALAQVDTLRSDLGAVQNRFNSAITNLGNTVNNLSSARSRIEDSDYATEVSNMSRAQILQQAGTSVLAQANQVPQNVLSLLR

SEQ ID NO: 814 - protein, 497 aa, E. coli flagellin (P04949)
AQVINTNSLSLITQNNINKNQSALSSSIERLSSGLRINSAKDDAAGQAIANRFTSNIKGLTQAARNANDGISVAQTTEGALSEINNNLQRVRELTVQATTGTNSESDLSSIQDEIKSRLDEIDRVSGQTQFNGVNVLAKNGSMKIQVGANDNQTITIDLKQIDAKTLGLDGFSVKNNDTVTTSAPVTAFGATTTNNIKLTGITLSTEAATDTGGTNPASIEGVYTDNGNDYYAKITGGDNDGKYYAVTVANDGTVTMATGATANATVTDANTTKATTITSGGTPVQIDNTAGSATANLGAVSLVKLQDSKGNDTDTYALKDTNGNLYAADVNETTGAVSVKTITYTDSSGAASSPTAVKLGGDDGKTEVVDIDGKTYDSADLNGGNLQTGLTAGGEALTAVANGKTTDPLKALDDAIASVDKFRSSLGAVQNRLDSAVTNLNNTTTNLSEAQSRIQDADYATEVSNMSKAQIIQQAGNSVLAKANQVPQQVLSLLQG

SEQ ID NO: 815 - protein, 393 aa, pseudomonas aerugienosa
ALTVNTNIASLNTQRNLNNSSASLNTSLQRLSTGSRINSAKDDAAGLQIANRLTSQVNGLNVATKNANDGISLAQTAEGALQQSTNILQRMRDLSLQSANGSNSDSERTALNGEVKQLQKELDRISNTTTFGGRKLLDGSFGVASFQVGSAANEIISVGIDEMSAESLNGTYFKADGGGAVTAATASGTVDIAIGITGGSAVNVKVDMKGNETAEQAAAKIAAAVNDANVGIGAFSDGDTISYVSKAGKDGSGAITSAVSGVVIADTGSTGVGTAAGVTPSATAFAKTNDTVAKIDISTAKGAQSAVLVIDEAIKQIDAQRADLGAVQNRFDNTINNLKNIGENVSAARGRIEDTDFAAETANLTKNQVLQQAGTAILAQANQLPQSVLSLLR

SEQ ID NO: 816 - protein, 506 aa, Artificial Sequence; identical to SEQ ID NO: 312
  STF2

SEQ ID NO: 817 - DNA, 345 bp, Artificial Sequence; identical to SEQ ID NO: 614
  EIII+

SEQ ID NO: 818 - protein, 116 aa, Artificial Sequence; identical to SEQ ID NO: 682
  JEIII+

SEQ ID NO: 819 - DNA, 348 bp, Artificial Sequence; identical to SEQ ID NO: 681
  JEIII+

SEQ ID NO: 820 - protein, 287 aa, Listeria monocytogenes
MKVNTNIISLKTQEYLRKNNEGMTQAQERLASGKRINSSLDDAAGLAVVTRMNVKSTGLDAASKNSSMGIDLLQTADSALSSMSSILQRMRQLAVQSSNGSFSDEDRKQYTAEFGSLIKELDHVADTTNYNNIKLLDQTATNAATQVSIQASDKANDLINIDLFNAKGLSAGTITLGSGSTVAGYSALSVADADSSQEATEAIDELINNISNGRALLGAGMSRLSYNVSNVNNQSIATKASASSIEDADMAAEMSEMTKYKILTQTSISMLSQANQTPQMLTQLINS

SEQ ID NO: 821 - protein, 12 aa, Artificial Sequence
  muturational cleavage site
  VARIANT 4: Xaa = Any Amino Acid
RGLXGAIAGFIE

SEQ ID NO: 822 - protein, 12 aa, Artificial Sequence
  muturational cleavage site
  VARIANT 4: Xaa = Any Amino Acid
RGLXGAIAGFIE

SEQ ID NO: 823 - protein, 4 aa, Artificial Sequence
  flagellin peptide
TIAL

SEQ ID NO: 824 - protein, 4 aa, Artificial Sequence
  flagellin peptide
TTLD

SEQ ID NO: 825 - protein, 7 aa, Artificial Sequence
  flagellin peptide
GTDQKID

SEQ ID NO: 826 - protein, 6 aa, Artificial Sequence
  flagellin peptide
NGEVTL

SEQ ID NO: 827 - protein, 12 aa, Artificial Sequence
  muturational cleavage site
SGLDDAAIKAAT

SEQ ID NO: 828 - protein, 12 aa, Artificial Sequence
  muturational cleavage site
RGIFGAIAGFIE

SEQ ID NO: 829 - protein, 5 aa, Artificial Sequence
  flagellin peptides
GADAA

SEQ ID NO: 830 - protein, 4 aa, Artificial Sequence
  flagellin peptides
AGGA

SEQ ID NO: 831 - protein, 4 aa, Artificial Sequence
  flagellin peptides
PATA

SEQ ID NO: 832 - protein, 4 aa, Artificial Sequence
  flagellin peptides
AAGA

SEQ ID NO: 833 - protein, 4 aa, Artificial Sequence
  flagellin peptides
ATTK

SEQ ID NO: 834 - protein, 12 aa, Artificial Sequence
  flagellin peptides
AGATKTTMPAGA

SEQ ID NO: 835 - protein, 5 aa, Artificial Sequence
  flagellin peptides
VTGTG

SEQ ID NO: 836 - protein, 10 aa, Artificial Sequence
  flagellin peptides
TEAKAALTAA

SEQ ID NO: 837 - protein, 11 aa, Artificial Sequence
  flagellin peptides
ASVVKMSYTDN

SEQ ID NO: 838 - protein, 9 aa, Artificial Sequence
  flagellin peptides
VDATDANGA

SEQ ID NO: 839 - protein, 19 aa, Artificial Sequence
  muturational cleavage site
RERRRKKRGLFGAIAGFIE

SEQ ID NO: 840 - protein, 494 aa, Artificial Sequence
  flagellin 1UCU
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSVRSRIEDSDYATEVSNMSRAQILQQAGTSVLAQANQVPQNVLSLLR

SEQ ID NO: 841 - protein, 505 aa, Artificial Sequence
  flagellin Sf1a
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 842 - protein, 4 aa, Artificial Sequence
  Linker
CSSN

What is claimed is:

1. A composition comprising at least a portion of at least one flagellin that initiates an intracellular signal transduction pathway for a Toll-like Receptor and a portion of a protein of a naturally occurring influenza viral hemagglutinin that lacks a transmembrane domain, a cytoplasmic domain and an HA2 subunit and includes at least a portion of a globular head and at least a portion of at least one secondary structure having at least one β-sheet at a bottom of the portion of the globular head that causes the portion of the globular head to essentially retain its tertiary structure.

2. The composition of claim 1, further including a carrier protein.

3. The composition of claim 1, wherein the flagellin and the portion of the naturally occurring influenza viral hemagglutinin are components of a fusion protein.

4. The composition of claim 1, wherein the flagellin includes at least one member selected from the group consisting of *Salmonella typhimurium* flagellin, an *E. coli* flagellin, a *S. muenchen* flagellin, a *Yersinia* flagellin and a *Campylobacter* flagellin, a *P. aeruginosa* flagellin and a *L. monocytogenes* flagellin.

5. The composition of claim 1, wherein the flagellin includes a Toll-like Receptor 5 binding site, whereby the composition activates an innate response.

6. The composition of claim 3, wherein the flagellin of the fusion protein includes a Toll-like Receptor 5 binding site, whereby the fusion protein activates an innate immune response.

7. The composition of claim 1, wherein the portion of the protein of the naturally occurring influenza viral hemagglutinin includes an HA1-1 portion of the naturally occurring influenza viral hemagglutinin.

8. The composition of claim 7, wherein the flagellin and the HA1-1 portion are components of a fusion protein.

9. The composition of claim 1, wherein the portion of the protein of the naturally occurring influenza viral hemagglutinin includes an HA1-2 portion of the naturally occurring influenza viral hemagglutinin.

10. The composition of claim 9, wherein the flagellin and the HA1-2 protein portion are components of a fusion protein.

11. The composition of claim 1, wherein the portion of the protein of the naturally occurring influenza viral hemagglutinin is not glycosylated.

12. A composition comprising at least a portion of at least one flagellin that initiates an intracellular signal transduction pathway for a Toll-like Receptor and a non-glycosylated portion of a protein of a naturally occurring influenza viral hemagglutinin that lacks a membrane fusion domain, a transmembrane domain, and a cytoplasmic domain and includes at least a portion of a globular head and at least a portion of at least one secondary structure having at least one β-sheet at a bottom of the portion of the globular head that causes the portion of the globular head to essentially retain its tertiary structure.

13. The composition of claim 12, wherein the flagellin and the portion of the naturally occurring influenza viral hemagglutinin are components of a fusion protein.

14. The composition of claim 12, wherein the flagellin includes at least one member selected from the group consisting of *Salmonella typhimurium* flagellin, an *E. coli* flagellin, a *S. muenchen* flagellin, a *Yersinia* flagellin and a *Campylobacter* flagellin, a *P. aeruginosa* flagellin and a *L. monocytogenes* flagellin.

15. The composition of claim 12, wherein the flagellin includes a Toll-like Receptor 5 binding site, whereby the composition activates an innate response.

16. The composition of claim 15, wherein the flagellin of the fusion protein includes a Toll-like Receptor 5 binding site, whereby the fusion protein activates an innate immune response.

17. The composition of claim 12, wherein the portion of the protein of the naturally occurring influenza viral hemagglutinin includes an HA1-1 protein portion of the naturally occurring influenza viral hemagglutinin.

18. The composition of claim 17, wherein the flagellin and the HA1-1 protein portion are components of a fusion protein.

19. The composition of claim 12, wherein the portion of the protein of the naturally occurring influenza viral hemagglutinin includes an HA1-2 protein portion of the naturally occurring influenza viral hemagglutinin.

20. The composition of claim 19, wherein the flagellin and the HA1-2 protein portion are components of a fusion protein.

21. The composition of claim 1, wherein the portion of the protein of the naturally occurring influenza viral hemagglutinin further includes at least one β-sandwich at the bottom of the portion of the globular head.

22. The composition of claim 21, wherein the portion of the protein of the naturally occurring influenza viral hemagglutinin further includes at least two β-strands at the bottom of the portion of the globular head.

23. The composition of claim 12, wherein the portion of the protein of the naturally occurring influenza viral hemagglutinin further includes at least one β-sandwich at the bottom of the portion of the globular head.

24. The composition of claim 23, wherein the portion of the protein of the naturally occurring influenza viral hemagglutinin further includes at least two β-strands at the bottom of the portion of the globular head.

25. The composition of claim 1, wherein the naturally occurring viral hemagglutinin is at least one member selected from the group consisting of a H1, H2, H3, H5, H7 and H9 strain.

26. The composition of claim 3, wherein the fusion protein includes an amino acid linker between the flagellin and the portion of the naturally occurring influenza viral hemagglutinin.

27. The composition of claim 1, wherein the naturally occurring influenza viral hemagglutinin is at least one member selected from the group consisting of an influenza A viral hemagglutinin and an influenza B viral hemagglutinin.

28. The composition of claim 1, wherein the influenza viral hemagglutinin is the influenza C viral hemagglutinin.

29. The composition of claim 12, wherein the naturally occurring viral hemagglutinin is at least one member selected from the group consisting of a H1, H2, H3, H5, H7 and H9 strain.

30. The composition of claim 13, wherein the fusion protein includes an amino acid linker between the flagellin and the portion of the naturally occurring influenza viral hemagglutinin.

31. The composition of claim 12, wherein the naturally occurring influenza viral hemagglutinin is at least one member selected from the group consisting of an influenza A viral hemagglutinin and an influenza B viral hemagglutinin.

32. The composition of claim 12, wherein the influenza viral hemagglutinin is the influenza C viral hemagglutinin.

33. The composition of claim 22, wherein:

i) the flagellin and the portion of the naturally occurring influenza viral hemagglutinin are components of a fusion protein that includes an amino acid linker between the flagellin and the portion of the naturally occurring influenza viral hemagglutinin; and ii) the naturally occurring influenza viral hemagglutinin is a H3 strain.

34. The composition of claim 23, wherein:

i) the flagellin and the portion of the naturally occurring influenza viral hemagglutinin are components of a fusion protein that includes an amino acid linker between the flagellin and the portion of the naturally occurring influenza viral hemagglutinin; and ii) the naturally occurring influenza viral hemagglutinin is a H3 strain.

* * * * *

UNITED STATES PATENT AND TRADEMARK OFFICE

CERTIFICATE OF CORRECTION

PATENT NO. : 8,420,102 B2
APPLICATION NO. : 11/714873
DATED : April 16, 2013
INVENTOR(S) : Langzhou Song et al.

It is certified that error appears in the above-identified patent and that said Letters Patent is hereby corrected as shown below:

In the Claims

In Claim 34, col. 260, line 11, replace "claim 23" with -- claim 24 --.

Signed and Sealed this
Sixteenth Day of July, 2013

Teresa Stanek Rea
*Acting Director of the United States Patent and Trademark Office*